(12) United States Patent
Jacobs et al.

(10) Patent No.: US 9,134,326 B2
(45) Date of Patent: Sep. 15, 2015

(54) BIOMARKERS FOR LIVER FIBROSIS

(71) Applicant: Battelle Memorial Institute, Richland, WA (US)

(72) Inventors: Jon M. Jacobs, Pasco, WA (US); Kristin E. Burnum-Johnson, Richland, WA (US); Erin M. Baker, West Richland, WA (US); Richard D. Smith, Richland, WA (US); Marina A. Gritsenko, Richland, WA (US); Daniel Orton, Pasco, WA (US)

(73) Assignee: Battelle Memorial Institute, Richland, WA (US)

( * ) Notice: Subject to any disclaimer, the term of this patent is extended or adjusted under 35 U.S.C. 154(b) by 0 days.

(21) Appl. No.: 14/209,860

(22) Filed: Mar. 13, 2014

(65) Prior Publication Data

US 2014/0273275 A1  Sep. 18, 2014

Related U.S. Application Data

(60) Provisional application No. 61/785,225, filed on Mar. 14, 2013.

(51) Int. Cl.
 *G01N 31/00* (2006.01)
 *G01N 33/53* (2006.01)
 *G01N 33/68* (2006.01)

(52) U.S. Cl.
 CPC ...... *G01N 33/6893* (2013.01); *G01N 2800/085* (2013.01)

(58) Field of Classification Search
 CPC ............... C07K 2317/76; A61K 2039/505; G01N 2500/10; C12N 7/00
 See application file for complete search history.

(56) References Cited

FOREIGN PATENT DOCUMENTS

WO    WO 2007/130636 A2    11/2007

OTHER PUBLICATIONS

Baker et al., "Advancing the High Throughput Identification of Liver Fibrosis Protein Signatures Using Multiplexed Ion Mobility Spectrometry," *Mol Cell Proteomics* 13:1119-1127, 2014.
Diamond et al., "HepatoProteomics: Applying Proteomic Technologies to the Study of Liver Function and Disease," *Hepatol.* 44:299-308, 2006.
Baker et al., "Utilizing High Throughput LC-IMS-QTOF MS Separations to Increase Proteome Coverage for Complex Biological and Environmental Samples," ASMS, Abstract, May 2012.
Baker et al., "Advancing the High Throughput Identification of Disease Specific Protein Signatures Using Multiplexed Ion Mobility Spectrometry," *Mol. Cell Proteomics* 2014. [Epub ahead of print].
Bell et al., "Serum Proteomics and Biomarker Discovery Across the Spectrum of Nonalcoholic Fatty Liver Disease," *Hepatology* 51:111-120, 2010.
Cheung et al., "Usefulness of a Novel Serum Proteome-Derived Index FI-PRO (Fibrosis-Protein) in the Prediction of Fibrosis in Chronic Hepatitis C.," *Eur. J. Gastroenterol. Hepatol.* 23:701-710, 2011.
Christensen et al., "Diagnostic Accuracy of Fibrosis Serum Panel (FIBROSpect II) Compared with Knodell and Ishak Liver Biopsy Scores in Chronic Hepatitis C Patients," *J. Viral Hepatitis.* 13:652-658, 2006.
Mukherjee and Sorrell, "Noninvasive Tests for Liver Fibrosis," *Semin. Liver Dis.* 26:337-347, 2006.
Plebani and Basso, "Non-Invasive Assessment of Chronic Liver and Gastric Diseases," *Clin. Chim. Acta* 381:39-49, 2007.
Rockey and Bissell, "Noninvasive Measures of Liver Fibrosis," *Hepatology* 43:S113-S120, 2006.
Shaheen et al., "Fibrotest and FibroScan for the Prediction of Hepatitis C-Related Fibrogenesis: A Systematic Review of Diagnostic Test Accuracy," *Am. J. Gasteroenterol.* 102:2589-2600, 2007.

*Primary Examiner* — Lisa Cook
(74) *Attorney, Agent, or Firm* — Klarquist Sparkman, LLP

(57) ABSTRACT

Methods and systems for diagnosing or prognosing liver fibrosis in a subject are provided. In some examples, such methods and systems can include detecting liver fibrosis-related molecules in a sample obtained from the subject, comparing expression of the molecules in the sample to controls representing expression values expected in a subject who does not have liver fibrosis or who has non-progressing fibrosis, and diagnosing or prognosing liver fibrosis in the subject when differential expression of the molecules between the sample and the controls is detected. Kits for the diagnosis or prognosis of liver fibrosis in a subject are also provided which include reagents for detecting liver fibrosis related molecules.

20 Claims, 9 Drawing Sheets
(9 of 9 Drawing Sheet(s) Filed in Color)

FIGS. 1A-1C
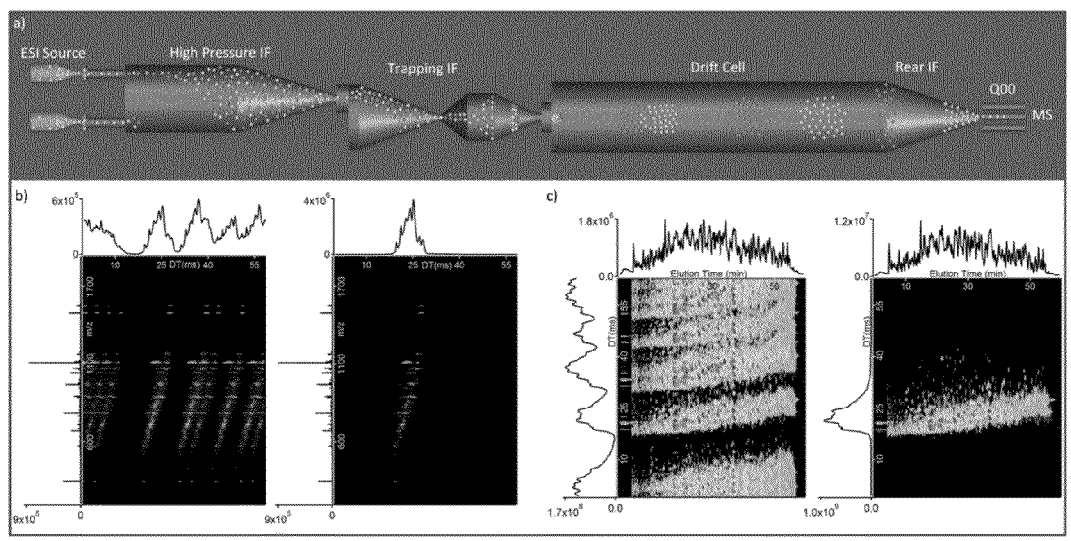
FIG. 2A
FIG. 2B
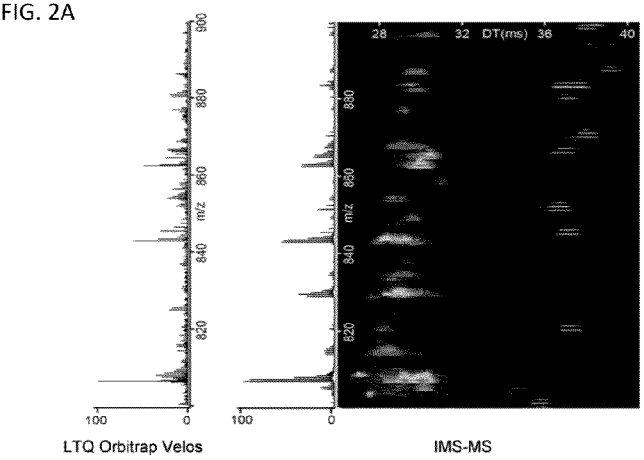
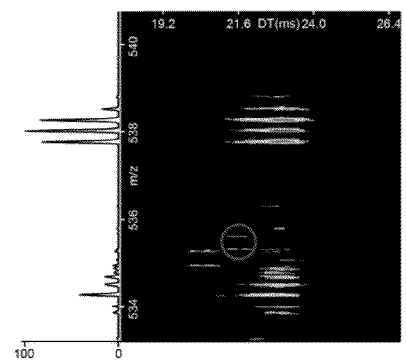
LTQ Orbitrap Velos       IMS-MS SUBSET 1 (Cluster 2)

SUBSET 2 (Cluster 4)

BIOMARKERS FOR LIVER FIBROSIS

CROSS-REFERENCE TO RELATED APPLICATION

This application claims priority to U.S. Provisional Application No. 61/785,225 filed Mar. 14, 2013, herein incorporated by reference in its entirety.

ACKNOWLEDGMENT OF GOVERNMENT SUPPORT

This invention was made with government support under 5P41RR018522-10 awarded by the National Institutes of Health's National Center for Research Resources, under 8 P41 GM103493-10 awarded by the National Institute of General Medical Sciences, under R21-CA12619-01 and U24-CA-160019-01 awarded by the National Cancer Institute, and DE-AC05-76RLO01830 awarded by the Department of Energy. The Government has certain rights in the invention.

FIELD

The present disclosure generally relates to methods and systems for the screening and detection of persons having or at risk for liver fibrosis, as well as kits that can be used with such methods and systems.

BACKGROUND

To date pre-clinical and clinical applications of mass spectrometry (MS)-based proteomic techniques analyzing complex biofluids have fallen short of expectations, largely due to deficiencies in both analytical sensitivity and throughput. These deficiencies result in measurements typically failing to confidently detect and quantify proteins at moderate to low concentrations, or not providing sufficient sample analysis throughput for statistical relevance. Higher sensitivity targeted MS analyses are currently utilized to address these shortcomings [1, 2]; however, these often only analyze a small list of proteins identified as biologically significant. While targeted MS measurements are increasingly common in clinical applications [3, 4], the limited number of proteins they examine does not necessarily reflect the biodiversity across a population, making broad untargeted measurements useful in developing individual disease metrics for diagnosis [5]. As the future of medicine proceeds toward a personal profiling approach [6, 7], the potential for robust high throughput clinical measurements based upon MS is highly attractive if its deficiencies can be addressed.

An initial step in attaining broad untargeted measurements that increasingly retain the benefits of targeted analyses exploits technological advances such as faster separations, more effective ion sources, detectors with greater dynamic range, and MS measurements with both higher resolution and accuracy. Advanced liquid-phase separations have already been employed to provide a significant sensitivity increase as illustrated by the higher number of proteins detected in liquid chromatography (LC)-MS-based studies [8]; however, the long LC separations most compatible with blood samples are extremely time-consuming. Fast gas-phase ion mobility spectrometry (IMS) separations that take place on the time scale of tens of milliseconds offer an additional separation stage and a way of reducing the need for extended LC separation times. In an IMS separation, ions subject to an electric field while traveling through a buffer gas separate quickly based on ion shape, e.g. compact species drift faster than those with extended structures [9, 10]. IMS can be coupled between LC and orthogonal acceleration time-of-flight (TOF) MS stages, and by combining the three orthogonal separations into a single LC-IMS-MS instrumentation platform, multidimensional high-resolution nested spectra are produced containing elution times, mass-to-charge ratios (m/z) and IMS drift times for all detectable ions in a sample [11, 12]

Liver fibrosis may result from a wide variety of conditions including chronic alcohol exposure, hepatitis B virus (HBV) infection, non-alcoholic fatty liver disease (NAFLD), hepatitis C virus (HCV) infection, Wilson's disease, alpha-1-antitrypsin deficiency, hemochromatosis, primary biliary cirrhosis, primary sclerosing cholangitis, and autoimmune hepatitis. Chronic HCV is the leading contributor to chronic liver disease and represents a worldwide public health concern affecting an estimated 130-170 million people [16]. The liver damage ensuing from HCV infection is also the leading cause of liver transplants in the United States and Europe and a major burden on healthcare services [17, 18]. In this disease, the liver elicits a persistent inflammatory and repair response known as fibrosis, which is characterized by the formation of fibrous tissue and scarring on the liver. Because the prognosis of HCV patients is related to the development of fibrosis and the risk of cirrhosis and hepatocellular carcinoma, an accurate evaluation of fibrogenic progression is important for patient care.

Currently, liver biopsies are the primary technique for generating information on the degree of fibrosis; however, they have multiple disadvantages, including risk of complications (e.g., major bleeding or inadvertent puncture of the lung, kidney, or colon), cost and occasionally inaccurate findings due to small specimen size and variability in histology evaluation. These disadvantages have spurred the development of noninvasive methods that can reliably predict, diagnose and assess the degree of fibrosis [19, 20].

SUMMARY

The present disclosure provides methods of diagnosing or prognosing liver fibrosis in a subject. Such methods can include detecting or measuring expression of at least two (e.g., at least 3, at least 4, at least 5 or at least 10) liver fibrosis-related molecules (such as proteins or nucleic acids) in a sample obtained from the subject, comparing the detected expression in the sample to controls representing expression of the at least two (e.g., at least 3, at least 4, at least 5 or at least 10) liver fibrosis-related molecules expected in a subject who does not have liver fibrosis or who has non-progressing liver fibrosis, and diagnosing or prognosing liver fibrosis in the subject when there is differential expression of the at least two (e.g., at least 3, at least 4, at least 5 or at least 10) liver fibrosis-related molecules between the sample and the controls, such as an increase or decrease in expression of at least 10% or at least 1.1 fold.

Also provided are one or more non-transitory computer-readable media that include computer-executable instructions causing a computing system to perform the methods provided herein.

Systems for analyzing a sample (such as a sample obtained from a subject suspected of having liver fibrosis) obtained from a subject are also provided. Such systems can include a means for measuring a level of at least two (e.g., at least 3, at least 4, at least 5 or at least 10) liver fibrosis-related molecules the sample (such as an antibody, probe, or primer) and means for diagnosing or prognosing liver fibrosis in the subject based on the level of the at least two liver fibrosis-related molecules. In some examples, the system includes implemented rules for determining diagnosing or prognosing liver fibrosis (e.g., positive or negative) based on the measured level of the at least two liver fibrosis-related molecules. In some examples, the system includes implemented rules for comparing the measured level of the at least two liver fibrosis-related molecules to a reference value, such as the level of the at least two liver fibrosis-related molecules positive or negative control (such as values expected in a subject who does not have liver fibrosis or who has non-progressing liver fibrosis). In some examples, the reference values are stored values. In some examples, the reference values are a level of the at least two liver fibrosis-related molecules measured from a control sample by said means for measuring. The system can also include one or more means for implementing the rules, whereby an indication of diagnosing or prognosing liver fibrosis (e.g., positive or negative) is provided based on the differential expression determined for the at least two liver fibrosis-related molecules measured in the patient sample and the control (e.g., reference value). Kits are also provided for the diagnosis or prognosis of liver fibrosis in a subject. Such kits can include reagents for detecting at least two (e.g., at least 3, at least 4, at least 5 or at least 10) liver fibrosis-related molecules (such as proteins or nucleic acids). In some embodiments, the kit has antibodies specific for at least two (e.g., at least 3, at least 4, at least 5 or at least 10) different liver fibrosis-related proteins. In some embodiments, the kit further includes labeled secondary antibodies which can bind to the antibodies specific for the proteins liver fibrosis-related proteins. In some embodiments, the kit has oligonucleotide probes or primers specific for at least two (e.g., at least 3, at least 4, at least 5 or at least 10) different liver fibrosis-related nucleic acid molecules.

The foregoing and other objects and features of the disclosure will become more apparent from the following detailed description, which proceeds with reference to the accompanying figures.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIG. 1A is a schematic representation of the ESI-IMS-MS regions of the overall platform. The smaller conformational ions (green circles) and larger conformational ions (red circles) illustrate the size separation in the IMS drift cell.

FIG. 1B provides a multiplexed nested IMS spectrum on the left shows both IMS drift time (x-axis) and m/z (y-axis) for a 9 peptide mixture. In this spectrum, 8 ion packets were released into the drift cell simultaneously. The corresponding de-multiplexed spectrum with all ions deconvoluted to their correct drift times is shown on the right. The intensity in the nested spectra is represented by color, with red being the most intense and blue being the least.

FIG. 1C shows the results of adding LC to LC-IMS-MS analyses. The plots illustrate the LC dimension total ion chromatogram (x-axis) and IMS drift time (y-axis) for a human serum dataset before (left) and after (right) de-multiplexing. The intensity in the nested spectra is represented by color, with red being the most intense and blue being the least.

FIG. 2A shows MS spectra for the LTQ Orbitrap Velos (left) and IMS-MS (right). The plots illustrate the reduction in noise in the IMS-MS spectrum and demonstrate how additional drift time information greatly simplifies peak detection, ultimately leading to more identifications.

FIG. 2B shows an LC-IMS-MS spectra with (Dynorphin A porcine)$^{3+}$ (circled) spiked at 100 pg/mL into human serum. The IMS-MS spectra are displayed as two-dimensional nested plots for IMS drift time (x-axis) and m/z (y-axis). The intensity in the nested spectra is represented by color, with red being the most intense and blue being the least.

SEQUENCE LISTING

Figure 3:
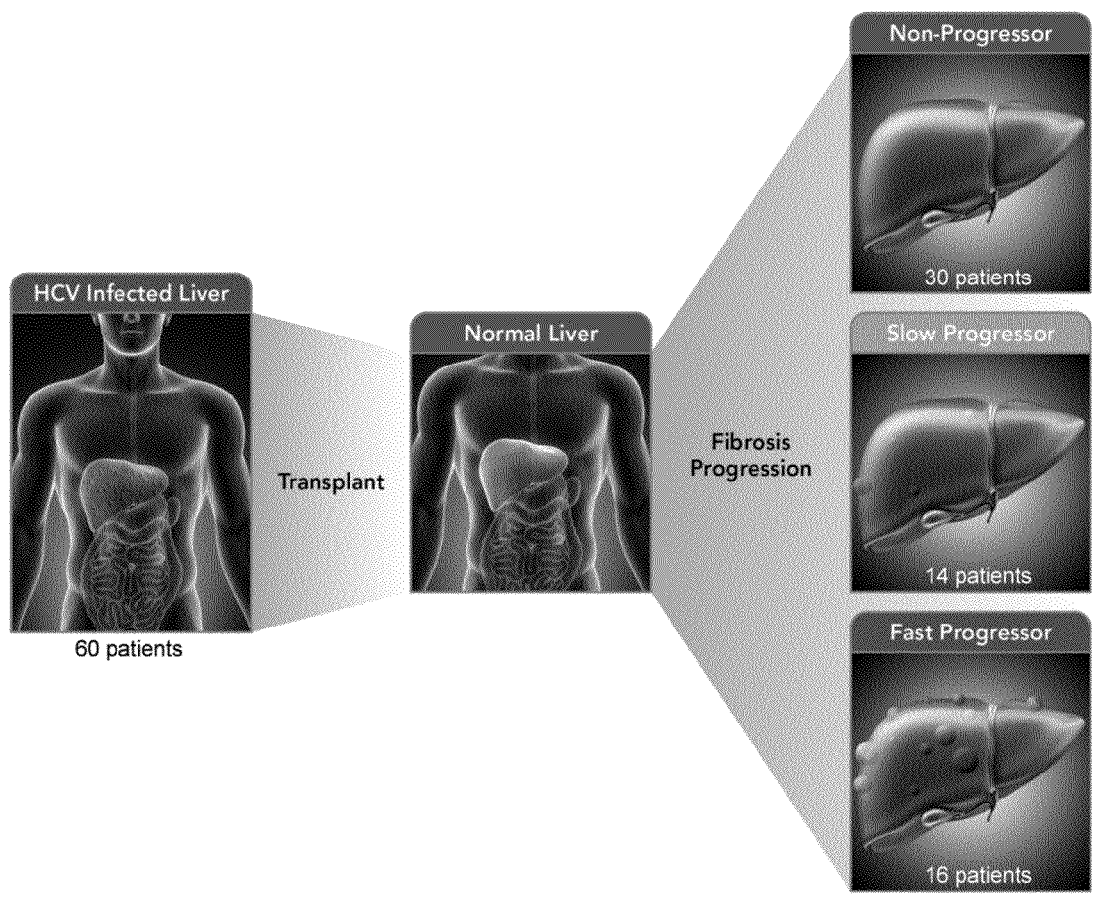
FIG. 3 illustrates the categorization of 60 HCV patients following liver transplant. Blood samples from the 60 HCV patients following liver transplant were utilized. Based on the amount of fibrosis occurring in each patient's liver several months to a few years following the procedure, the patients were categorized into non-, slow or fast progressing liver fibrosis groups. A biostatistician selected patients for the study so that a non-progressor patient could be donor, age and cold ischemia time matched to either a slow or fast progressor, resulting in 30 well-annotated patient pairs.

SEQ ID NOS: 1-5544 show peptide sequences that were detected using the disclosed methods.

DETAILED DESCRIPTION OF SEVERAL EMBODIMENTS

Abbreviations and Terms

The following explanations of terms and methods are provided to better describe the present disclosure and to guide those of ordinary skill in the art in the practice of the present disclosure. The singular forms "a," "an," and "the" refer to one or more than one, unless the context clearly dictates otherwise. For example, the term "comprising a protein" includes single or plural proteins and is considered equivalent to the phrase "comprising at least one protein." The term "or" refers to a single element of stated alternative elements or a combination of two or more elements, unless the context clearly indicates otherwise. As used herein, "comprises" means "includes." Thus, "comprising A or B," means "including A, B, or A and B," without excluding additional elements.

Unless explained otherwise, all technical and scientific terms used herein have the same meaning as commonly understood to one of ordinary skill in the art to which this disclosure belongs. Although methods and materials similar or equivalent to those described herein can be used in the practice or testing of the present disclosure, suitable methods and materials are described below. The materials, methods, and examples are illustrative only and not intended to be limiting. While the methods have been described and were utilized in testing, it is to be distinctly understood that the disclosure is not limited to any particular form of testing utilized, but is intended to include all methods that are capable of detecting the materials that are set forth in the claims. All references provided herein are incorporated by reference, as are the sequences associated with the Gen Bank Accession number provided herein (sequences available on Mar. 14, 2013).

Alarm: A notification (such as an audio or visual (e.g., color, picture, or text) notification) indicating the presence or absence of liver fibrosis, the presence or absence of fast-progressing liver fibrosis, the presence or absence of slow-progressing liver fibrosis, and/or the presence or absence of non-progressing liver fibrosis. The alarm may be activated when analysis of a subject's sample yields results meeting criteria for liver fibrosis, fast-progressing liver fibrosis, slow-progressing liver fibrosis, and/or non-progressing liver fibrosis. The criteria may be determined by the manufacturer of a kit, system, or device that includes the alarm or may, alternatively, be activated based upon a standard as entered by a clinician or other end-user.

Antibody: A polypeptide ligand including at least a light chain or heavy chain immunoglobulin variable region which specifically recognizes and binds an epitope of an antigen, such as a liver fibrosis marker or a fragment thereof (such as the proteins or peptides listed in any of Tables 1, 2, 3, 5, 6 and 12, as well as any of SEQ ID NOS: 1-5544). Antibodies are composed of a heavy and a light chain, each of which has a variable region, termed the variable heavy ($V_H$) region and the variable light ($V_L$) region. Together, the $V_H$ region and the $V_L$ region are responsible for binding the antigen recognized by the antibody. In one example, an antibody specifically binds to one of the proteins or peptides listed in any of Tables 1, 2, 3, 5, 6 and 12, as well as any of SEQ ID NOS: 1-5544, but not other proteins (such as other proteins found in human serum or plasma).

This includes intact immunoglobulins and the variants and portions of them well known in the art, such as Fab' fragments, F(ab)'$_2$ fragments, single chain Fv proteins ("scFv"), and disulfide stabilized Fv proteins ("dsFv"). A scFv protein is a fusion protein in which a light chain variable region of an immunoglobulin and a heavy chain variable region of an immunoglobulin are bound by a linker, while in dsFvs, the chains have been mutated to introduce a disulfide bond to stabilize the association of the chains. The term also includes genetically engineered forms such as chimeric antibodies (for example, humanized murine antibodies), heteroconjugate antibodies (such as, bispecific antibodies). See also, *Pierce Catalog and Handbook*, 1994-1995 (Pierce Chemical Co., Rockford, Ill.); Ku by, J., *Immunology*, $3^{rd}$ Ed., W.H. Freeman & Co., New York, 1997.

Typically, a naturally occurring immunoglobulin has heavy (H) chains and light (L) chains interconnected by disulfide bonds. There are two types of light chain, lambda and kappa. There are five main heavy chain classes (or isotypes) which determine the functional activity of an antibody molecule: IgM, IgD, IgG, IgA and IgE.

Each heavy and light chain contains a constant region and a variable region, (the regions are also known as "domains"). In combination, the heavy and the light chain variable regions specifically bind the antigen. Light and heavy chain variable regions contain a "framework" region interrupted by three hypervariable regions, also called "complementarity-determining regions" or "CDRs". The extent of the framework region and CDRs have been defined (see, Kabat et al., *Sequences of Proteins of Immunological Interest*, U.S. Department of Health and Human Services, 1991). The Kabat database is now maintained online. The sequences of the framework regions of different light or heavy chains are relatively conserved within a species. The framework region of an antibody, that is the combined framework regions of the constituent light and heavy chains, serves to position and align the CDRs in three-dimensional space.

The CDRs are primarily responsible for binding to an epitope of an antigen. The CDRs of each chain are typically referred to as CDR1, CDR2, and CDR3, numbered sequentially starting from the N-terminus, and are also typically identified by the chain in which the particular CDR is located. Thus, a $V_H$ CDR3 is located in the variable domain of the heavy chain of the antibody in which it is found, whereas a $V_L$ CDR1 is the CDR1 from the variable domain of the light chain of the antibody in which it is found. An antibody that binds to a particular liver fibrosis marker will have a specific $V_H$ region and the $V_L$ region sequence, and thus specific CDR sequences. Antibodies with different specificities (i.e. different combining sites for different antigens) have different CDRs. Although it is the CDRs that vary from antibody to antibody, only a limited number of amino acid positions within the CDRs are directly involved in antigen binding. These positions within the CDRs are called specificity determining residues (SDRs).

References to "$V_H$" or "VH" refer to the variable region of an immunoglobulin heavy chain, including that of an Fv, scFv, dsFv or Fab. References to "$V_L$" or "VL" refer to the variable region of an immunoglobulin light chain, including that of an Fv, scFv, dsFv or Fab.

A "monoclonal antibody" is an antibody produced by a single clone of B-lymphocytes or by a cell into which the light and heavy chain genes of a single antibody have been transfected. Monoclonal antibodies are produced by methods known to those of skill in the art, for instance by making hybrid antibody-forming cells from a fusion of myeloma cells with immune spleen cells. Monoclonal antibodies include humanized monoclonal antibodies.

A "polyclonal antibody" is an antibody that is derived from different B-cell lines. Polyclonal antibodies are a mixture of immunoglobulin molecules secreted against a specific antigen, each recognizing a different epitope. These antibodies are produced by methods known to those of skill in the art, for instance, by injection of an antigen into a suitable mammal (such as a mouse, rabbit or goat) that induces the B-lymphocytes to produce IgG immunoglobulins specific for the antigen which are then purified from the mammal's serum.

A "chimeric antibody" has framework residues from one species, such as human, and CDRs (which generally confer antigen binding) from another species, such as a murine antibody that specifically binds to one of the proteins or peptides listed in any of Tables 1, 2, 3, 5, 6 and 12, as well as any of SEQ ID NOS: 1-5544.

A "humanized" immunoglobulin is an immunoglobulin including a human framework region and one or more CDRs from a non-human (for example a mouse, rat, or synthetic) immunoglobulin. The non-human immunoglobulin providing the CDRs is termed a "donor," and the human immunoglobulin providing the framework is termed an "acceptor." In one embodiment, all the CDRs are from the donor immunoglobulin in a humanized immunoglobulin. Constant regions need not be present, but if they are, they are substantially identical to human immunoglobulin constant regions, e.g., at least about 85-90%, such as about 95% or more identical. Hence, all parts of a humanized immunoglobulin, except possibly the CDRs, are substantially identical to corresponding parts of natural human immunoglobulin sequences. Humanized immunoglobulins can be constructed by means of genetic engineering (see for example, U.S. Pat. No. 5,585, 089).

Array: An arrangement of molecules, such as biological macromolecules (such as peptides, antibodies, aptamers, aptazymes or nucleic acid molecules, such as nucleic acid probes), in addressable locations on or in a substrate. A "microarray" is an array that is miniaturized so as to require or be aided by microscopic examination for evaluation or analysis.

The array of molecules ("features") makes it possible to carry out a very large number of analyses on a sample at one time. In certain example arrays, one or more molecules (such as oligonucleotide probes, aptamers, aptazymes, or antibodies) will occur on the array a plurality of times (such as twice), for instance to provide internal controls. The number of addressable locations on the array can vary, for example from at least two, at least 3, at least 4, at least 5, at least 10, at least 20, at least 30, at least 50, at least 75, at least 100, at least 150, at least 200, at least 300, at least 500, least 550, at least 600, at least 800, at least 1000, at least 10,000, or more. In particular examples, an array includes nucleic acid molecules, such as oligonucleotide sequences that are at least 15 nucleotides in length, such as about 15-40 nucleotides in length. In particular examples, an array includes aptamers, aptazymes, or antibodies to detect target proteins.

In particular examples, an array includes oligonucleotide probes or primers which can be used to detect liver fibrosis-associated nucleic acids. Protein-based arrays include probe molecules that are or include proteins, or where the target molecules are or include proteins, and arrays including nucleic acids to which proteins are bound, or vice versa. For example, such arrays can be used to detect any combination of at least two of the liver fibrosis-related proteins (or nucleic acids encoding such proteins) listed in any of Tables 1, 2, 3, 5, 6 and 12, as well as any of SEQ ID NOS: 1-5544, such as at least 3, at least 4, at least 5, at least 6, at least 7, at least 8, at least 9, at least 10, at least 15, at least 20, at least 22, at least 25, at least 30, at least 35, at least 40, or at least 45 of the molecules listed in any of Tables 1, 2, 3, 5, 6 and 12, as well as any of SEQ ID NOS: 1-5544.

Within an array, each arrayed sample is addressable, in that its location can be reliably and consistently determined within at least two dimensions of the array. The feature application location on an array can assume different shapes. For example, the array can be regular (such as arranged in uniform rows and columns) or irregular. Thus, in ordered arrays the location of each sample is assigned to the sample at the time when it is applied to the array, and a key may be provided in order to correlate each location with the appropriate target or feature position. Often, ordered arrays are arranged in a symmetrical grid pattern, but samples could be arranged in other patterns (such as in radially distributed lines, spiral lines, or ordered clusters). Addressable arrays usually are computer readable, in that a computer can be programmed to correlate a particular address on the array with information about the sample at that position (such as hybridization or binding data, including for instance signal intensity). In some examples of computer readable formats, the individual features in the array are arranged regularly, for instance in a Cartesian grid pattern, which can be correlated to address information by a computer.

Binding affinity: Affinity of one molecule for another, such as an antibody, aptamer, or aptazyme for an antigen (for example, the proteins or peptides shown in any of Tables 1, 2, 3, 5, 6 and 12, as well as any of SEQ ID NOS: 1-5544). In one example, affinity is calculated by a modification of the Scatchard method described by Frankel et al., *Mol. Immunol.*, 16:101-106, 1979. In another example, binding affinity is measured by an antigen/antibody dissociation rate. In yet another example, a high binding affinity is measured by a competition radioimmunoassay. In several examples, a high binding affinity is at least about $1 \times 10^{-8}$ M. In other examples, a high binding affinity is at least about $1.5 \times 10^{-8}$, at least about $2.0 \times 10^{-8}$, at least about $2.5 \times 10^{-8}$, at least about $3.0 \times 10^{-8}$, at least about $3.5 \times 10^{-8}$, at least about $4.0 \times 10^{-8}$, at least about $4.5 \times 10^{-8}$, or at least about $5.0 \times 10^{-8}$ M. The determination that a particular agent binds substantially only to a single liver fibrosis marker peptide may readily be made by using or adapting routine procedures. One suitable in vitro assay makes use of the Western blotting procedure (described in many standard texts, including Harlow and Lane, Using Antibodies: A Laboratory Manual, CSHL, New York, 1999).

Control: A sample, standard, or reference value(s) used for comparison with a test sample. In some embodiments, the control is a sample obtained from a healthy patient (or plurality of patients) (also referred to herein as a "normal" control), such as a normal sample (e.g., one from a patient(s) that does not have liver fibrosis). In some embodiments, the control is a historical control or standard value(s) (e.g., a previously tested control sample or group of samples that represent baseline or normal values). In some embodiments the control is a standard value representing the average value (or average range of values) obtained from a plurality of patient samples, such as an average value of the amount (e.g., relative or absolute) for each protein or peptide listed in any of Tables 1, 2, 3, 5, 6 and 12, as well as any of SEQ ID NOS: 1-5544, in patients without liver fibrosis or in patients with non-progressing liver fibrosis.

A control can also be represented by a reference value or range of values representing an amount of activity or expression determined to be representative of a given condition. Reference values can include a range of values, real or relative expected to occur under certain conditions. These values can be compared with experimental values to determine if a given molecule is up-regulated or down-regulated in a particular sample. In one example, a reference value or range of values represents an amount of activity or expression of a liver fibrosis related protein or peptide in a sample, such as a sample from a patient that does not have liver fibrosis (and who may or may not have a liver transplant) or from a subject with no-progressing liver fibrosis. This value can then be used to determine if the subject from whom a test sample was obtained has liver fibrosis (such as fast- or slow-progressing liver fibrosis) or is at high risk for developing liver fibrosis (such as fast- or slow-progressing liver fibrosis) by comparing this reference value of expression to the level of expression detected in the test sample. In a particular example, a significant change in expression or activity in four or more liver fibrosis related molecules (such an increase or decrease of at least 10%, at least 20%, at least 30%, at least 40%, at least 50%, at least 75%, at least 80%, at least 90%, at least 100%, at least 150%, at least 200%, or at least 300% for those in any of Tables 1, 2, 3, 5, 6 and 12, as well as any of SEQ ID NOS: 1-5544) in a test sample as compared to such a reference value indicates that the subject has liver fibrosis or is at a high risk for liver fibrosis. In a particular example, a significant change in expression or activity in four or more liver fibrosis related molecules (such an increase or decrease of at least 1.2 fold, at least 1.3 fold, at least 1.4 fold, at least 1.5 fold, at least 1.6 fold, at least 1.7 fold, at least 1.8 fold, at least 1.9 fold, at least 2 fold, at least 2.1 fold, at least 2.2 fold, or at least 2.5 fold for those in any of Tables 1, 2, 3, 5, 6 and 12, as well as any of SEQ ID NOS: 1-5544) in a test sample as compared to such a reference value indicates that the subject has liver fibrosis or is at a high risk for liver fibrosis.

Detect: To measure, determine, or identify the existence, occurrence, presence, or fact of something. General methods of detecting are known to the person of ordinary skill in the art and may be supplemented with the protocols and reagents disclosed herein. For example, included herein are methods of detecting a protein or peptide shown in any of Tables 1, 2, 3, 5, 6 and 12, as well as any of SEQ ID NOS: 1-5544. Detection can be qualitative or quantitative and may be direct or indirect. Detection can be in bulk, so that a macroscopic number of molecules can be observed simultaneously. Detection can also include identification of signals from single molecules using microscopy and such techniques as total internal reflection to reduce background noise.

Diagnosis: The process of identifying a disease by its signs, symptoms and/or results of one or more tests, such as those provided herein. The conclusion reached through that process is also called "a diagnosis." Forms of testing commonly performed include blood tests, medical imaging, genetic analysis, urinalysis, biopsy and analysis of biological samples obtained from a subject. In one example diagnosis is determining whether a subject has liver fibrosis. In another example, diagnosis is determining whether a subject has fast progressing liver fibrosis. In yet another example, diagnosis is determining whether a subject has slow progressing liver fibrosis.

Differential expression: A difference, such as an increase or decrease, in the conversion of the information encoded in a gene (such as a liver fibrosis related gene) into messenger RNA, the conversion of mRNA to a protein, or both. In an example, the difference is relative to a control or reference value, such as an amount of protein expression that is expected in a subject who does not have liver fibrosis. In another example, the difference is relative to a control or reference value, such as an amount of protein or gene expression that is expected in a subject that has a non-progressing liver fibrosis. In another example, the difference is relative to a control or reference value, such as an amount of protein or gene expression that is expected in a subject that has a slow-progressing liver fibrosis. Detecting differential expression can include measuring a change in gene or protein expression, such as a change in amount (e.g., qualitative or quantitative) of one or more liver fibrosis related proteins, such as those listed in any of Tables 1, 2, 3, 5, 6 and 12, as well as any of SEQ ID NOS: 1-5544.

Downregulated or inactivated: When used in reference to the expression of a protein, refers to any process which results in a decrease in production or expression of a protein, such as a decrease of at least 10%, at least 20%, at least 50%, or at least 90%, such as an at least 1.2-fold, at least 1.5 fold, at least 2-fold, at least 3-fold, at least 4-fold, or at least 5-fold decrease. Protein downregulation includes any significant decrease in the detectable protein in a sample. In certain examples, the detectable protein in a sample decreases by at least 10%, at least 20%, at least 50%, or at least 90%, such as at least 1.2-fold, at least 1.5 fold, at least 2-fold, at least 3-fold or at least 4-fold, as compared to a control (such an amount of the detectable protein in a sample from a normal subject, such as one without liver fibrosis). In one example, a control is a relative amount of protein expression in a serum sample from a subject who does not have liver fibrosis. Similarly, when used in reference to the expression of a nucleic acid, such as cDNA or mRNA, refers to any process which results in a decrease in production or expression of a nucleic acid, such as a decrease of at least 10%, at least 20%, at least 50%, or at least 90%, such as an at least 1.2-fold, at least 1.5 fold, at least 2-fold, at least 3-fold, at least 4-fold, or at least 5-fold decrease.

Label: A detectable compound. In some examples, a label is conjugated directly or indirectly to another molecule, such as an antibody, protein, or nucleic acid probe, to facilitate detection of that molecule. In this case, the molecule such as an antibody, nucleic acid probe, or protein is labeled with the detectable compound. The label can be capable of detection by, for example, ELISA, spectrophotometry, flow cytometry, or microscopy. Specific, non-limiting examples of labels include fluorophores, chemiluminescent agents, enzymatic linkages, and radioactive isotopes. Methods for labeling and guidance in the choice of labels appropriate for various purposes are discussed for example in Sambrook et al. (Molecular Cloning: A Laboratory Manual, Cold Spring Harbor, N.Y., 1989) and Ausubel et al. (In Current Protocols in Molecular Biology, John Wiley & Sons, New York, 1998). In a particular example, a label is conjugated to an antibody or aptamer specific for a protein or peptide disclosed in any of Tables 1, 2, 3, 5, 6 and 12, as well as any of SEQ ID NOS: 1-5544 to allow for the diagnosis of liver fibrosis. In another example, a label is conjugated to a secondary antibody specific for an antibody which is in turn specific for a protein or peptide disclosed in any of Tables 1, 2, 3, 5, 6 and 12, as well as any of SEQ ID NOS: 1-5544 to allow for the diagnosis of liver fibrosis.

Liver Fibrosis: The scarring process that occurs in the liver in response to injury to the liver and involves excessive accumulation of extracellular matrix proteins such as collagen. Liver fibrosis is often a result of chronic inflammation of the liver due to, for example, infection with hepatitis C virus (HCV). Chronic inflammation leads to changes in liver structure, to slowing of blood circulation, and necrosis of liver cells. Liver fibrosis is a dynamic process that may progress or regress over periods as short as months. As scar tissue builds up, due to inflammation and the continuance of liver injury, it can eventually disrupt the metabolic functions of the liver. Advanced liver fibrosis can result in cirrhosis, liver failure, and portal hypertension and often requires liver transplantation (and can occur following liver transplantation).

Liver fibrosis may occur in one of at least four stages. Stage 1 liver fibrosis (portal stage) is characterized by normal sized triads, portal inflammation and possible subtle bile duct damage. Granulomas may be detected in Stage 1 liver fibrosis. Stage 2 liver fibrosis (periportal stage) may be characterized by enlarged triads, periportal fibrosis and/or inflammation. Stage 2 is characterized by the finding of a proliferation of small bile ducts. Stage 3 (septal stage) liver fibrosis is characterized by active and/or passive fibrous septa. Stage 4 is characterized by biliary cirrhosis and liver nodules.

Liver fibrosis may be associated with elevations of liver enzymes such as aspartate aminotransferase (AST), alanine aminotransferase (ALT) and alkaline phosphatase (AP). Elevated liver enzymes may show up in blood tests before any actual fibrosis occurs in response to the damage that leads to the fibrosis. The present disclosure provides non-invasive methods of diagnosing and prognosing liver fibrosis.

As liver functioning is impaired overt signs and symptoms may manifest including inflammation, pain in the area of the liver, loss of appetite, nausea and vomiting, jaundice (yellowing of the skin and the whites of the eyes), spider angioma, caput medusa (appearance of dilated veins on the abdomen), and discoloration of the skin in rash-like patches. Overt signs and/or symptoms may indicate that the scarring has progressed to a potentially dangerous level but will not occur in all cases or stages of liver fibrosis.

Liver-fibrosis-related molecule(s): A nucleic acid or protein (or fragment thereof) whose expression is affected by liver fibrosis. Specific exemplary proteins include those listed in Tables 1, 2, 3, 5, 6 and 12, as well as fragments thereof (such as the peptides in SEQ ID NOS: 1-5544), whose expression is altered (such as upregulated or downregulated) in response to liver fibrosis (such as slow- or fast-progressing liver fibrosis). Examples of liver fibrosis-related molecules whose expression is upregulated following development of liver fibrosis include those in Table 1 with a positive Log 2 fold change such as alpha-1-antitrypsin, galectin-3-binding protein, von Willebrand factor, complement protein C7, extracellular matrix protein 1, actin—cytoplasmic 1 (ACTB), and sulfhydryl oxidase 1, Hemoglobin subunit beta, apolipotrotein E, and sex hormone binding globulin. Specific examples of liver fibrosis-related molecules whose expression is downregulated following development of liver fibrosis include those in Table 1 with a negative Log 2 fold change such as prothrom bin, BCHE (Cholinesterase), Retinol binding protein 4, IGFALS, transthyretin, alpha-1-acid glycoprotein 1, alpha-1-acid glycoprotein 2, fibrinogen alpha chain, apolipoprotein C-Ill, serum albumin, Beta-Ala-His dipeptidase, Coagulation factor XI, Plasma kallikrein, and coagulation factor IX (as well as nucleic acids encoding such proteins).

Liver fibrosis-related molecules also include families of proteins, such as those associated with liver metabolism (e.g., F2, BCHE, RBP4, TTR, IGFALS, and IGFBP3), the innate immune response (e.g., CFI, C4A, C6, CBA, C7, MBL2, MASP2, and FCN3), oxidative stress (e.g., QSOX1, GPX3, and PRDX2), and liver fibrosis (e.g., F10, C5, VTN, ECM, LGALS3BP, and LUM).

Liver fibrosis-related molecules can be involved in or influenced by liver fibrosis in different ways, including causative (in that a change in a liver fibrosis-related protein leads to development of or progression to liver fibrosis) or resultive (in that development of or progression to liver fibrosis causes or results in a change in the liver fibrosis-related molecule).

Prognosis: To determine whether a subject will develop a disease in the future, such as the predisposition of a subject to develop liver fibrosis in the future, such as slow- or fast-progressing liver fibrosis.

Protein: An amino acid-based molecule as found in a mammal or other subject. Includes full length amino acid molecules, as well as a portion of the naturally occurring full-length amino acid based molecule, such as at least 10 contiguous amino acids of the full-length naturally occurring protein. A protein may accordingly be a peptide which may or may not be found in a mammal but may instead form part of a larger molecule present naturally in a mammal. As a specific example, the "proteins listed in any of Tables 1, 2, 3, 5, 6 and 12, as well as any of SEQ ID NOS: 1-5544" includes the full-length listed proteins, fragments of at least 10 contiguous amino acids of each of the listed proteins (such as the peptides in any of SEQ ID NOS: 1-5544), a precursor (e.g., a pro-protein or a pre-pro-protein) of the listed proteins, or an amino-acid based metabolite of one of the listed proteins.

Sample: Biological specimens containing protein and/or nucleic acid molecules, such as those present in peripheral blood or fraction thereof, urine, saliva, tissue biopsy (such as a liver biopsy sample), surgical specimen, fine needle aspirates, and autopsy material. In one example, a sample includes plasma or serum obtained from a mammalian subject. In one example, the sample is a liquid sample.

Subject: Living multicellular vertebrate organisms having a liver. This term includes both human and veterinary subjects who have a liver, such as those that are in need of the desired diagnosis, such as diagnosis of liver fibrosis. Examples of mammals include, but are not limited to: humans, pigs, cows, goats, cats, dogs, rabbits and mice. In one example, a subject has or is susceptible to developing liver fibrosis, such as one infected with hepatitis B or C. In one example, the subject has received a liver transplant.

Therapeutically effective amount: A dose sufficient to prevent advancement, delay progression, or to cause regression of a disease, or which is capable of reducing symptoms caused by the disease, such as liver fibrosis. In one example, a therapeutically effective amount is an amount of a therapy sufficient to reduce inflammation in the liver, reduce liver enzyme levels (such as AST, ALT, and/or AP) and/or reduce scarring of the liver by at least 10%, at least 20%, at least 50%, at least 70%, or at least 90%. In one example, a therapeutically effective amount is an amount of a therapy sufficient to increase liver function in a fibrotic liver, for example an increase of at least 10%, at least 20%, at least 50%, at least 70%, or at least 90% as compared to an absence of therapy.

Upregulated or activated: When used in reference to the expression of a protein, refers to any process which results in an increase in production or expression of a protein, such as an increase of at least 10%, at least 20%, at least 50%, or at least 90%, such as an at least 1.2-fold, at least 1.5 fold, at least 2-fold, at least 3-fold, at least 4-fold, or at least 5-fold increase. Protein upregulation includes any significant increase in the detectable protein in a sample. In certain examples, the detectable protein in a sample increases by at least 10%, at least 20%, at least 50%, or at least 90%, such as 1.2-fold, at least 1.5 fold, at least at least 2-fold, at least 3-fold or at least 4-fold, as compared to a control (such an amount of the detectable protein in a sample from a normal subject). In one example, a control is a relative amount of protein expression in a serum sample from a subject who does not have liver fibrosis. Similarly, when used in reference to the expression of a nucleic acid, such as cDNA or mRNA, refers to any process which results in an increase in production or expression of a nucleic acid, such as an increase of at least 10%, at least 20%, at least 50%, or at least 90%, such as an at least 1.2-fold, at least 1.5 fold, at least 2-fold, at least 3-fold, at least 4-fold, or at least 5-fold increase relative to a control.

Overview

Rapid diagnosis and prognosis of disease using less invasive, safer, and more clinically acceptable approaches than presently employed is a goal for medicine. While mass spectrometry (MS)-based proteomics approaches have attempted to meet these objectives, challenges such as the enormous dynamic range of protein concentrations in clinically relevant biofluid samples coupled with the need to address human biodiversity have slowed their employment. Provided herein is the use of a new instrumental platform that addresses these challenges by coupling technical advances in rapid gas phase multiplexed ion mobility spectrometry (IMS) separations with liquid chromatography (LC) and MS to dramatically increase measurement sensitivity and throughput. Using this LC-IMS-MS platform, blood serum samples from 60 non-transplant and 60 post-liver transplant patients with recurrent fibrosis progression were analyzed, and relevant proteins and protein fragments identified. The multidimensional LC-IMS-MS platform provided herein greatly improves upon existing MS technologies in analytical sensitivity and specificity, enhances dynamic range of measurements, and provides reliable identification and quantitation of low abundance analyte species in highly complex biological matrices. Additionally the enhanced throughput of the new platform demonstrate the ability of this technology in clinical studies Thus, coupling ion mobility spectrometry (IMS) separation to MS can increase measurement sensitivity while simultaneously reducing analysis time, allowing the IMS-MS platform to be used to identify clinically relevant proteins. These proteins and peptide fragments can be detected in a biological sample, such as blood or a fraction thereof, to diagnose or prognose liver fibrosis.

Based on this identification, methods, systems, and kits are provided for diagnosing and/or prognosing liver fibrosis by analyzing the expression of several protein markers (or their corresponding nucleic acids) in a biological sample. Methods, systems, and kits are also provided for determining progression type (fast-progressing, slow-progressing and non-progressing) for subjects having liver fibrosis. Accurate detection and identification protein markers related to liver fibrosis, rather than more limited individual biomarkers, has been demonstrated herein. Use of larger panels of protein markers can aid in the reliable prognosis, diagnosis, tracking and determination of disease progression. Moreover, a method for reliable identification and quantitation of low abundance liver fibrosis-related proteins has been demonstrated. Early detection of liver fibrosis can be accomplished by comparing the expression levels of the liver fibrosis-related proteins (or nucleic acids) to control levels reflecting average protein (or nucleic acid) levels in a normal population or in relevant sub-populations. Alternatively, an individual's protein (or nucleic acid) abundances can be compared to a baseline panel established specifically for that person prior to disease onset. The method can performed using a variety of detection methods including immunoassays or mass spectrometry (MS) approaches.

One or more steps of the disclosed methods can be performed by a suitably-programmed computer. For example, the determined level of expression for the at least 2 liver fibrosis-related molecules listed in any of Tables 1, 2, 3, 5, 6 and 12, as well as any of SEQ ID NOS: 1-5544, in a sample obtained from the subject can be inputted into a computer or algorithm, which then generates an output, thereby analyzing the sample. In some examples, the output (such as a visual or audible output) is an indication as to whether the subject has or will likely develop fibrosis of the liver (such as a fast or slow-progressing fibrosis). This can allow a physician to identify those subjects who should receive anti-fibrosis therapy. Also provided are one or more non-transitory computer-readable media that include computer-executable instructions causing a computing system to perform the methods provided herein.

Systems for diagnosing or prognosing liver fibrosis in a subject are also provided. Such systems can include a means for measuring a level of at least two, at least 3, or at least 4 liver fibrosis-related molecules listed in any of Tables 1, 2, 3, 5, 6 and 12, as well as any of SEQ ID NOS: 1-5544, in a sample obtained from the subject. In some examples, such means include a mass spectrometer, ion mobility separator, liquid chromatography materials, light microscope, automated tissue or slide stainer, computer, or combinations thereof. In some examples, the system includes implemented rules for comparing the measured level of liver fibrosis-related molecules to one or more corresponding reference values or controls (for example to provide an indication as to whether there is differential expression). In some examples, the reference values are stored values or stored digital images. In some examples, the reference values are levels of liver fibrosis-related molecules measured from a control sample by said means for measuring. The system can also include one or more means for implementing the rules (such as a computer or algorithm), whereby a diagnosis or prognosis of liver fibrosis is provided based on the measured level of liver fibrosis-related molecules (for example if differential expression is detected).

Methods for Diagnosis and Prognosis of Liver Fibrosis

The disclosure provides methods for diagnosing liver fibrosis in a subject. Diagnosis can include determining that the subject currently has liver fibrosis, such as a slow-, or fast-progressing liver fibrosis. Also provided are methods for prognosing liver fibrosis in a subject. Prognosis can include determining that the subject will develop liver fibrosis in the future, such as a non-progressing, slow- or fast-progressing liver fibrosis, or include determining that current liver fibrosis in the subject will be non-progressing, slow- or fast-progressing liver fibrosis in the future.

The disclosed methods can include detecting a plurality of liver fibrosis-related molecules (e.g., at least 2, at least 3, or at least 4, at least 5, at least 6, at least 7, at least 8, at least 9, or at least 10 proteins or corresponding nucleic acid molecules) in a sample obtained from the subject. For example, protein expression can be detected in a biological sample using routine methods (such as immunoassays and spectrometry). In one example, protein expression is detected in a sample using liquid chromatography ion mobility mass spectrometry (LC-IMS-MS). The detected liver fibrosis related molecules are compared to a control(s), wherein the control may represent expression of the same liver fibrosis-related molecules (e.g., proteins) in a subject who does not have liver fibrosis or who has non-progressing liver fibrosis. Liver fibrosis is diagnosed in the subject when differential expression of the two or more liver fibrosis-related molecules between the sample and the control is detected or observed. Similarly, liver fibrosis is prognosed in the subject when differential expression of the at least two (e.g., at least 3, at least 4, at least 5, at least 6, at least 7, at least 8, at least 9, or at least 10) liver fibrosis-related molecules between the sample and the control is detected.

Various methods can be employed to select the at least two (e.g., at least 3, at least 4, at least 5, at least 6, at least 7, at least 8, at least 9, or at least 10) liver fibrosis-related molecules for inclusion in the disclosed methods, kits or other panel. In some embodiments, the at least two (e.g., at least 3, at least 4, at least 5, at least 6, at least 7, at least 8, at least 9, or at least 10) liver fibrosis-related molecules are selected at least in part based on having a high level of differential expression such as, for example, at least 20% differential expression relative to a control representing the level of expression in a subject without liver fibrosis or with non-progressing liver fibrosis. In some embodiments, the at least two (e.g., at least 3, at least 4, at least 5, at least 6, at least 7, at least 8, at least 9, or at least 10) liver fibrosis-related molecules are selected at least in part based on having a high level of sensitivity, individually or in combination, such as at least 90%, 95%, 96%, 97%, 98% or 99% sensitivity for the diagnosis or prognosis of liver fibrosis (such as moderate to advanced liver fibrosis). In some embodiments, the at least two (e.g., at least 3, at least 4, at least 5, at least 6, at least 7, at least 8, at least 9, or at least 10) proteins are selected at least in part based on having a high level of specificity, individually or in combination, such as at least 90%, 95%, 96%, 97%, 98% or 99% specificity for the diagnosis or prognosis of liver fibrosis (such as moderate to advanced liver fibrosis). In some embodiments, the at least two (e.g., at least 3, at least 4, at least 5, at least 6, at least 7, at least 8, at least 9, or at least 10) liver fibrosis-related molecules are selected at least in part based on the ability to distinguish various types and/or levels of liver fibrosis based on the differential expression detected. For example, one or more of the liver fibrosis-related molecules can be chosen at least in part based on an expectation of increased expression of the protein in fast-progressing liver fibrosis relative to a control and decreased expression of the protein relative to the control in slow-progressing liver fibrosis (e.g., where control is no liver fibrosis or non-progressing liver fibrosis).

In some examples, the method is performed at least one month, at least two months, at least six months or at least one year before the onset of clinical signs and symptoms that indicate liver fibrosis, including signs and symptoms indicating fast-progressing or slow-progressing liver fibrosis, regardless of cause. Specifically, the method may be performed at least one month, at least two months, at least six months or at least one year before the onset of portal hypertension and/or clinical manifestations of portal hypertension such caput medusa and ascites. In some examples, the method is performed at least one month, at least two months, at least six months or at least one year before the elevation above the normal range in the subject of one, two or three of AST, ALT and alkaline phosphatase.

In various embodiments, the method detects or prognoses liver fibrosis with a sensitivity of at least 80%, at least 85%, at least 90% or at least 95%; and a specificity of at least 80%, at least 85%, at least 90% or at least 95%. In various embodiments, the method detects or prognoses fast-progressing liver fibrosis with a sensitivity of at least 80%, at least 85%, at least 90% or at least 95% and a specificity of at least 80%, at least 85%, at least 90% or at least 95%. In various embodiments, the method detects or prognoses slow-progressing liver fibrosis with a sensitivity of at least 80%, at least 85%, at least 90% or at least 95%; and a specificity of at least 80%, at least 85%, at least 90% or at least 95%. In some examples, differential expression of the at least two (e.g., at least 3, at least 4, at least 5, at least 6, at least 7, at least 8, at least 9, or at least 10) liver fibrosis-related molecules may be detected as early as 1 day, as early as 2 days, as early as 5 days, or as early as 10 days following the onset of pathological fibrotic change in the liver.

I. Exemplary Liver Fibrosis Related Molecules

This section provides descriptions for several exemplary liver fibrosis-related molecules which can be used in the disclosed methods and kits. In some examples, the disclosed methods or systems include detecting or measuring expression of at least 2, at least 3, at least 4, at least 5, at least 6, at least 7, at least 8, at least 9, at least 10, at least 11, at least 12, at least 13, at least 14, or at least 15 of the liver fibrosis-related molecules listed below, such as 2, 3, 4, 5, 6, 7, 8, 9, 10, 11, 12, 13, 14 or all 15 of the liver fibrosis-related molecules listed below.

In some examples, the disclosed methods include detecting or measuring expression of at least 2, at least 3, at least 4, or all 5 of QSOX1, ECM1, LGALS3BP, lumican and vitronectin. In some examples, the disclosed methods include detecting or measuring expression of at least 2, at least 3, at least 4, or all 5 of DOPA (DBH), transthyretin (TTR), cholinesterase (BCHE), retinol-binding protein (RBP4), and IGFALS. In some examples, the disclosed methods include detecting or measuring expression of at least 2, at least 3, at least 4 at least 5, at least 6, at least 7, at least 8, at least 9, or all 10 of QSOX1, ECM1, LGALS3BP, lumican, vitronectin, DOPA (DBH), transthyretin (TTR), BCHE, RBP4, and IGFALS. Similarly, in some examples, the disclosed kits include agents that permit detection or measurement of expression of at least 2, at least 3, at least 4, or all 5 of QSOX1, ECM1, LGALS3BP, lumican and vitronectin. In some examples, the disclosed kits include agents that permit detection or measurement of expression of at least 2, at least 3, at least 4, or all 5 of DOPA (DBH), TTR, BCHE, RBP4, and IGFALS. In some examples, the disclosed kits include agents that permit detection or measurement of expression of at least 2, at least 3, at least 4 at least 5, at least 6, at least 7, at least 8, at least 9, or all 10 of QSOX1, ECM1, LGALS3BP, lumican, vitronectin, DOPA (DBH), TTR, BCHE, RBP4, and IGFALS.

A. Extracellular matrix protein 1 (ECM1) (OMIM: 602201) is an extracellular protein containing motifs with a cysteine pattern characteristic of the cysteine pattern of the ligand-binding "double-loop" domains of the albumin protein family. This gene maps outside of the epidermal differentiation complex (EDC), a cluster of three gene families involved in epidermal differentiation. Alternatively spliced transcript variants encoding distinct isoforms have been described. Nucleic acid and protein sequences for ECM1 are publicly available. For example, GENBANK® Accession Nos.: NM_001202858.1 and NM_001252653.1 disclose exemplary ECM1 nucleic acid sequences, and GENPEPT® Accession Nos.: NP_001189787.1 (human) and NP_001239582.1 (mouse) disclose exemplary ECM1 protein sequences, all of which are incorporated by reference as provided by GENPEPT®/GENBANK® on Mar. 14, 2013. In certain examples, ECM1 has at least 80% sequence identity, for example at least 85%, 90%, 95%, or 98% sequence identity to a publicly available ECM1 sequence, and is upregulated in the presence of liver fibrosis.

B. Prothrombin (F2) (OMIM 176930) is a protein precursor enzymatically cleaved at two sites by activated Factor X (Xa) to produce thrombin. In the blood coagulation pathway, thrombin acts to convert factor XI to XIa, VIII to VIIIa, V to Va, and fibrinogen to fibrin. The F2 gene is located on the chromosome 11 in humans (11p11-q12). Prothrombin is produced in the liver and is post-translationally modified in a vitamin K-dependent reaction that converts ten glutamic acids on prothrombin to gamma-carboxyglutamic acid (Gla). Nucleic acid and protein sequences for F2 are publicly available. For example, GENBANK®Accession Nos.: NM_000506.2 (human) and NM_010168.2 (mouse) are exemplary F2 acid sequences, and GENPEPT® Accession Nos.: NP_000497.1 (human) and NP_034298.1 (mouse) disclose exemplary F2 protein sequences, all of which are incorporated by reference as provided by GENPEPT®/GENBANK® on Mar. 14, 2013. In certain examples, prothrombin has at least 80% sequence identity, for example at least 85%, 90%, 95%, or 98% sequence identity to a publicly available prothrombin sequence, and is downregulated in the presence of liver fibrosis.

C. Complement C4-A (C4-A) (OMIM 120810) a protein precursor forming part of the classical activation blood coagulation pathway. The protein is expressed as a single chain precursor which is proteolytically cleaved into a trimer of alpha, beta, and gamma chains prior to secretion. The trimer provides a surface for interaction between the antigen-antibody complex and other complement components. The alpha chain may be cleaved to release C4 anaphylatoxin, a mediator of local inflammation. This gene localizes to the major histocompatibility complex (MHC) class III region on chromosome 6 in humans. Nucleic acid and protein sequences for C4-A are publicly available. For example, GENBANK® Accession Nos.: NM_001252204.1 (human) and NM_009780.2 (mouse) are exemplary C4-A nucleic acid sequences, and GENPEPT®/GENBANK® Accession Nos.: NP_001239133.1 (human) and AAI41051.1 (mouse) disclose exemplary C4-A protein sequences, all of which are incorporated by reference as provided by GENPEPT®/GENBANK® on Mar. 14, 2013. In certain examples, C4-A has at least 80% sequence identity, for example at least 85%, 90%, 95%, or 98% sequence identity to a publicly available C4-A sequence, and is downregulated in the presence of liver fibrosis.

D. Sulfhydryl oxidase 1 (QSOX1) (OMIM: 603120; EC 1.8.3.2) is an enzyme whose expression is induced as fibroblasts begin to exit the proliferative cycle and enter quiescence. Nucleic acid and protein sequences for sulfhydryl oxidase are publicly available. For example, GENBANK® Accession Nos.: NM_001004128.2 (human) and NM_001024945.1 (mouse) are exemplary QSOX1 nucleic acid sequences, and GENPEPT® Accession Nos.: NP_001004128.1 (human) and NP_001020116.1 (mouse) disclose exemplary QSOX1 protein sequences, all of which are incorporated by reference as provided by GENPEPT®/GENBANK® on Mar. 14, 2013. In certain examples, QSOX1 has at least 80% sequence identity, for example at least 85%, 90%, 95%, or 98% sequence identity to a publicly available QSOX1 sequence, and is upregulated in the presence of liver fibrosis.

E. Galectin-3-binding protein (LGALS3BP) (OMIM: 600626) is a protein implicated in modulating cell-cell and cell-matrix interactions The full length 90K cDNA has been localized to chromosome 17q25 in humans. The native protein binds specifically to a human macrophage-associated lectin known as Mac-2 and also binds galectin 1. LGALS3BP has been found elevated in the serum of patients with cancer and in those infected by the human immunodeficiency virus (HIV). Nucleic acid and protein sequences for LGALS3BP are publicly available. For example, GENBANK® Accession Nos.: NM_005567.3 (human) and NM_011150.2 (mouse) are exemplary LGALS3BP nucleic acid sequences, and GENPEPT® Accession Nos.: NP_005558.1 (human) and NP_035280.1 (mouse) disclose exemplary LGALS3BP protein sequences, all of which are incorporated by reference as provided by GENPEPT®/GENBANK® on Mar. 14, 2013. In certain examples, LGALS3BP has at least 80% sequence identity, for example at least 85%, 90%, 95%, or 98% sequence identity to a publicly available LGALS3BP sequence, and is upregulated in liver fibrosis.

F. Coagulation Factor X (F10) (OMIM: 613872, EC 3.4.21.6) is an enzyme synthesized in the liver and requires vitamin K for its synthesis. Factor X is activated into factor Xa by both factor IX (with its cofactor, factor VIII) and factor VII with its cofactor, tissue factor. It acts by cleaving prothrombin in two places (an arg-thr and then an arg-ile bond), which yields the active thrombin. Nucleic acid and protein sequences for Coagulation Factor X are publicly available. For example, GENBANK® Accession Nos.: NM_000504.3 (human) and NM_001242368.1 (mouse) exemplary F10 nucleic acid sequences, and GENPEPT® Accession Nos.: NP_000495.1 (human) and NP_001229297.1 (mouse) disclose exemplary F10 protein sequences, all of which are incorporated by reference as provided by GENPEPT®/GENBANK® on Mar. 14, 2013. In certain examples, F10 has at least 80% sequence identity, for example at least 85%, 90%, 95%, or 98% sequence identity to a publicly available F10 sequence, and is upregulated in the presence of fast-progressing liver fibrosis but downregulated in the presence of slow-progressing liver fibrosis.

G. Cytoskeletal β-actin (Actin—cytoplasmic 1, ACTB) (OMIM: 102630) is a highly conserved actin protein involved in cell motility, structure and integrity. Nucleic acid and protein sequences for ACTB are publicly available. For example, GENBANK® Accession Nos.: NM_001101.3 (human) and NM_007393.3 (mouse) are exemplary ACTB nucleic acid sequences, and GENPEPT® Accession Nos.: NP_001092.1 (human) and NP_031419.1 (mouse) disclose exemplary ACTB protein sequences, all of which are incorporated by reference as provided by GENPEPT®/GENBANK® on Mar. 14, 2013. In certain examples, ACTB has at least 80% sequence identity, for example at least 85%, 90%, 95%, or 98% sequence identity to a publicly available ACTB sequence, and is upregulated in liver fibrosis.

H. Complement component 5 (C5) (OMIM: 120900) is a protein which plays an important role in inflammatory and cytotoxic processes. This protein is composed of alpha and beta polypeptide chains that are linked by a disulfide bridge. An activation peptide, C5a, which is an anaphylatoxin that possesses potent spasmogenic and chemotactic activity, is derived from the alpha polypeptide via cleavage with a convertase. The C5b macromolecular cleavage product can form a complex with the C6 complement component, and this complex is the basis for formation of the membrane attack complex, which includes additional complement components. Nucleic acid and protein sequences for C5 are publicly available. For example, GENBANK® Accession Nos.: NM_001735.2 (human) and NM_010406.2 (mouse) are exemplary C5 nucleic acid sequences, and GENPEPT® Accession Nos.: NP_001726.2 (human) and NP_034536.1 (mouse) disclose exemplary C5 protein sequences, all of which are incorporated by reference as provided by GENPEPT®/GENBANK® on Mar. 14, 2013. In certain examples, C5 has at least 80% sequence identity, for example at least 85%, 90%, 95%, or 98% sequence identity to a publicly available C5 sequence, and is upregulated in the presence of fast-progressing liver fibrosis but downregulated in the presence of slow-progressing liver fibrosis.

I. Vitronectin (VTN) (OMIM: 193190) is an abundant glycoprotein found in serum and the extracellular matrix that promotes cell adhesion and spreading, inhibits the membrane-damaging effect of the terminal cytolytic complement pathway, and binds to several serpin serine protease inhibitors. It is a secreted protein and exists in either a single chain form or a clipped, two chain form held together by a disulfide bond. Nucleic acid and protein sequences for VTN are publicly available. For example, GENBANK® Accession Nos.: NM_000638.3 (human) and NM_011707.2 (mouse) are exemplary VTN nucleic acid sequences, and GENPEPT® Accession Nos.: NP_000629.3 (human) and NP_035837.1 (mouse) disclose exemplary VTN protein sequences, all of which are incorporated by reference as provided by GENPEPT®/GENBANK® on Mar. 14, 2013. In certain examples, VTN has at least 80% sequence identity, for example at least 85%, 90%, 95%, or 98% sequence identity to a publicly available VTN sequence, and is up-regulated in the presence of fast-progressing liver fibrosis but down-regulated in the presence of slow-progressing liver fibrosis.

J. Lumican (LUM) (OMIM: 600616) is a protein which is the major keratan sulfate proteoglycan of the cornea but is also distributed in interstitial collagenous matrices throughout the body. Lumican may regulate collagen fibril organization and circumferential growth, corneal transparency, and epithelial cell migration and tissue repair. Nucleic acid and protein sequences for LUM are publicly available. For example, GENBANK® Accession Nos.: NM_002345.3 (human) and NM_008524.2 (mouse) are exemplary LUM nucleic acid sequences, and GENPEPT® Accession Nos.: NP_002336.1 (human) and NP_032550.2 (mouse) disclose exemplary LUM protein sequences, all of which are incorporated by reference as provided by GENPEPT®/GENBANK® on Mar. 14, 2013. In certain examples, LUM has at least 80% sequence identity, for example at least 85%, 90%, 95%, or 98% sequence identity to a publicly available LUM sequence, and is up-regulated in the presence of fast-progressing liver fibrosis but down-regulated in the presence of slow-progressing liver fibrosis.

K. Dopamine β-hydroxylase (DBH) (OMIM: 609312) is an enzyme (oxygenase) involved in the synthesis of small-molecule neurotransmitters and converts dopamine to norepinephrine. It is expressed in noradrenergic nerve terminals of the central and peripheral nervous systems, as well as in chromaffin cells of the adrenal medulla. Nucleic acid and protein sequences for DBH are publicly available. For example, GENBANK® Accession Nos.: NM_000787.3 (human) and NM_138942.3 (mouse) are exemplary DBH nucleic acid sequences, and GENPEPT®/GENBANK® Accession Nos.: NP_000778.3 (human) and NP_620392.2 (mouse) disclose exemplary DBH protein sequences, all of which are incorporated by reference as provided by GENPEPT®/GENBANK® on Mar. 14, 2013. In certain examples, DBH has at least 80% sequence identity, for example at least 85%, 90%, 95%, or 98% sequence identity to a publicly available DBH sequence, and is upregulated in the presence of liver fibrosis.

L. Transthyretin (TTR) (OMIM: 176300) is a protein and carrier of thyroxine (T4) and retinol binding protein (when bound to retinol). The liver secretes TTR into the blood, and the choroid plexus secretes TTR into the cerebrospinal fluid. Nucleic acid and protein sequences for TTR are publicly available. For example, GENBANK® Accession Nos.: NM_000371.3 (human) and NM_013697.5 (mouse) are exemplary TTR nucleic acid sequences, and GENPEPT®/GENBANK® Accession Nos.: NP_000362.1 (human) and NP_038725.1 (mouse) disclose exemplary TTR protein sequences, all of which are incorporated by reference as provided by GENPEPT®/GENBANK® on Mar. 14, 2013. In certain examples, TTR has at least 80% sequence identity, for example at least 85%, 90%, 95%, or 98% sequence identity to a publicly available TTR sequence, and is downregulated in the presence of liver fibrosis.

M. Butyrylcholinesterase (BCHE) (OMIM: 177400), also known as plasma cholinesterase or pseudocholinesterase, is a non-specific cholinesterase protein enzyme found primarily in the liver. Nucleic acid and protein sequences for BCHE are publicly available. For example, GENBANK® Accession Nos.: NM_000055.2 (human) and NM_009738.3 (mouse) are exemplary BCHE nucleic acid sequences, and GENPEPT®/GENBANK® Accession Nos.: NP_000046.1 (human) and NP_033868.3 (mouse) disclose exemplary BCHE protein sequences, all of which are incorporated by reference as provided by GENPEPT®/GENBANK® on Mar. 14, 2013. In certain examples, BCHE has at least 80% sequence identity, for example at least 85%, 90%, 95%, or 98% sequence identity to a publicly available BCHE sequence, and is downregulated in the presence of liver fibrosis.

N. Retinol-binding protein (RBP4) (OMIM: 180250) is a protein and specific carrier for retinol in the blood, delivering retinol from liver stores to peripheral tissues. Nucleic acid and protein sequences for RBP4 are publicly available. For example, GENBANK® Accession Nos.: NM_006744.3 (human) and NM_001159487.1 (mouse) are exemplary RBP4 nucleic acid sequences, and GENPEPT®/GENBANK® Accession Nos.: NP_006735.2 (human) and NP_001152959.1 (mouse) disclose exemplary RBP4 protein sequences, all of which are incorporated by reference as provided by GENPEPT®/GENBANK® on Mar. 14, 2013. In certain examples, RBP4 has at least 80% sequence identity, for example at least 85%, 90%, 95%, or 98% sequence identity to a publicly available RBP4 sequence, and is downregulated in the presence of liver fibrosis.

O. Insulin-like growth factor binding protein, acid labile subunit (IGFALS) (OMIM: 601489) is a serum protein that binds insulin-like growth factors, increasing their half-life and vascular localization. Nucleic acid and protein sequences for IGFALS are publicly available. For example, GENBANK® Accession Nos.: NM_001146006.1 (human) and NM_008340.3 (mouse) are exemplary IGFALS nucleic acid sequences, and GENPEPT®/GENBANK® Accession Nos.: NP_001139478.1 (human) and NP_032366.2 (mouse) disclose exemplary IGFALS protein sequences, all of which are incorporated by reference as provided by GENPEPT®/GENBANK® on Mar. 14, 2013. In certain examples, IGFALS has at least 80% sequence identity, for example at least 85%, 90%, 95%, or 98% sequence identity to a publicly available IGFALS sequence, and is downregulated in the presence of liver fibrosis.

II. Subjects

Liver fibrosis diagnosed or prognosed using the methods, systems, or kits herein can be due to any condition that results in cirrhosis or fibrosis, such as one or more of chronic alcohol exposure, hepatitis B virus (HBV) infection, non-alcoholic, steatohepatitis, hepatitis C virus (HCV) infection, Wilson's disease, alpha-1-antitrypsin deficiency, hemochromatosis, primary biliary cirrhosis, primary sclerosing cholangitis, and autoimmune hepatitis. Thus, in some examples, the subject to be diagnosed or prognosed is one having one or more of these conditions. In some examples, a subject having one or more of chronic alcohol exposure, hepatitis B virus infection, non-alcoholic, steatohepatitis, hepatitis C virus infection, Wilson's disease, alpha-1-antitrypsin deficiency, hemochromatosis, primary biliary cirrhosis, primary sclerosing cholangitis, and autoimmune hepatitis is selected for analysis with the disclosed methods.

Subjects that can be diagnosed or prognosed with the disclosed methods, systems, or kits include those that have or are suspected of having post-transplant liver fibrosis. Thus, in some examples, the method includes selecting a subject who has received a liver transplant. Subjects can be any subject with a liver, such as a mammal, for example a human or veterinary subject.

In some examples, the subject has previously received a liver transplant, and method is performed at least 10 days; at least 15 days; at least 30 days; at least 60 days; at least 90 days; at least 120 days; at least 200 days; at least 365 days; at least 2 years; or at least 3 years after liver transplant.

In some examples, the subject has been infected and/or exposed to HBV or HCV. Thus, in some examples the subject to be diagnosed or prognosed is one who has received a liver transplant and has been previously infected or exposed to HBV or HCV. For example, the disclosed methods can be is performed at least 6 months, at least 1 year, at least 2 years, at least 5 five years, at least 10 years, at least 15 years, at least 20 years, at least 25 years, or at least 30 years after the HBV or HCV exposure/infection.

In some examples, the subject is one who has been diagnosed with chronic alcoholism. Chronic alcoholism can lead to the accumulation of fatty deposits in the liver and eventual fibrosis, cirrhosis and liver failure. In some embodiments, the subject has chronic alcoholism and the method is performed at least 2 years, at least 3 years, at least 5 years, at least 10 years, at least 15 years, at least 20 years, at least 25 years, or at least 30 years after disease onset.

In some examples, the subject has alpha-antitrypsin (AAT) deficiency. Alpha-1 antitrypsin deficiency is an autosomal recessive genetic disorder causing both lung and liver diseases. There are several forms and degrees of deficiency, principally depending on whether the sufferer has one or two copies of the affected gene. The most common genotype of AAT deficiency is genotype PiZZ, which encodes mutant AAT, referred to as Z protein (ATZ). The fundamental pathological process of the AAT deficiency is the accumulation of mutant AAT as polymers within hepatocytes. The resultant low levels of AAT in the serum, result in lung damage by proteinases, and eventually emphysema. The protein accumulation in hepatocytes may play a role in the development of liver diseases, including chronic hepatitis, liver fibrosis, cirrhosis and hepatocellular carcinoma.

In some examples, the subject has hemochromatosis. Hereditary hemochromatosis (HH), is characterized by increased intestinal absorption of iron, which leads to deposition of iron in the body, e.g., in multiple organs such as liver, pancreas, heart and other organs. Excess iron deposition, if left untreated, causes tissue damage and fibrosis with irreversible damage to various organs, e.g. iron overloaded organs, e.g. endocrine dysfunction or hepatic fibrosis and cirrhosis.

In some examples, the subject has primary biliary cirrhosis (PBC). PBC is an autoimmune disease of the liver marked by the progressive destruction of small bile ducts of the liver, with the intralobular ducts affected early in the disease. When the ducts are damaged, bile may build up in the liver and over time damage the tissue and lead to scarring, fibrosis and cirrhosis. Those affected by PBC may present with symptoms of fatigue, pruritis (itchiness), jaundice and xanthomas.

In some examples, the subject has primary sclerosing cholangitis (PSC). PSC is a disease of the bile ducts that causes inflammation and subsequent obstruction of the bile ducts at an intra- and extra-hepatic level. The inflammation impedes the flow of bile to the gut which can lead to liver fibrosis, liver cirrhosis, liver failure and liver cancer. More than 80% of those with PSC have ulcerative colitis. Symptoms of PSC may be similar to those of PBC and can include pruritis, jaundice, fatigue, and malabsorption. Approximately 80% subjects with PSC have perinuclear anti-neutrophil cytoplasmic antibodies (p-ANCA).

In some examples, the subject has Wilson's disease. Wilson's disease, also known as hepatolenticular degeneration, is a rare inherited systemic disorder of copper metabolism. Individuals with Wilson's disease are unable to excrete copper into their bile, thus, copper begins to accumulate in the liver. Wilson's disease may cause acute or chronic hepatitis (inflammation of the liver) or cirrhosis (severe liver disease) due to a progressive loss of liver function. The degree of liver involvement is variable and may range from mild elevations of certain liver enzymes to complete liver failure. Symptoms associated with Wilson's disease include fatigue, anorexia, weight loss, generalized weakness, ascites and abdominal swelling, or jaundice. Other symptoms include enlargement of the liver (hepatomegaly), spleen (splenomegaly), or both (hepatosplenomegaly).

In some examples, the subject has nonalcoholic fatty liver disease (NAFLD) such as nonalcoholic steatohepatitis (NASH). Subjects with NAFLD have no drinking habit (less than 20 g daily), however give histological findings characterized by hepatic fatty deposition reminiscent of those found in alcoholic hepatic damage. The disease is regarded as a phenotype in the liver of metabolic syndrome accompanying obesity. NAFLD is divided into simple fatty liver and NASH. NASH is a progressive disease that frequently accompanies fibrosis and has been known to progress to hepatic cirrhosis and hepatic cancer. NAFLD may be suspected in subjects with high levels of triglyceride in the blood and may be diagnosed by abdominal ultrasonography and CT.

In some examples, the subject has autoimmune hepatitis. Autoimmune hepatitis is a disease of the liver that occurs when the body's immune system attacks cells of the liver. Anomalous presentation of human leukocyte antigen (HLA) class II on the surface of hepatocytes possibly due to a genetic predisposition or acute liver infection, causes a cell-mediated immune response against the body's own liver. This abnormal immune response results in inflammation of the liver, which can lead to further complications, including fibrosis and cirrhosis.

III. Differential Expression

Detecting differential expression can include measuring a change in gene or protein expression, such as a change in amount (e.g., qualitative or quantitative) of one or more liver fibrosis-related molecules (e.g., proteins, peptides, or nucleic acids). For example, measurement or detection of expression can be absolute or relative, and in some examples is quantified. In various embodiments, differential expression includes a detectable increase or decrease of at least 1.1-fold; at least 1.15-fold; at least 1.2-fold; at least 1.25-fold; at least 1.3-fold; at least 1.4-fold; at least 1.5-fold; at least 1.6-fold; at least 1.7-fold; at least 2-fold; at least 2.5-fold; at least 3-fold; at least 3.5-fold; or at least 4-fold relative to a control. In some embodiments, differential expression includes a detectable increase or decrease of at least 10%; at least 20%; at least 30%; at least 40%; at least 50%; at least 60%; at least 70%; at least 80%; at least 90%; at least 100%; at least 125%; at least 150%; at least 200%; at least 300%, or at least 400% relative to a control. In certain embodiments, differential expression of at least two (e.g., at least 3, at least 4, at least 5, at least 6, at least 7, at least 8, at least 9, or at least 10, such as 2, 5, 10 or 15) liver fibrosis-related molecules between the sample and the control is detected, wherein differential expression of at least 1.2 fold is detected for at least 50%; at least 75%; at least 80%; at least 90%; or all of the at least two (e.g., at least 3, at least 4, at least 5, at least 6, at least 7, at least 8, at least 9, or at least 10, such as 2, 5, 10 or 15) liver fibrosis-related molecules tested.

In one embodiment, the differential expression detected for each of the at least two (e.g., at least 3, at least 4, at least 5, at least 6, at least 7, at least 8, at least 9, or at least 10, such as 2, 5, 10 or 15) liver fibrosis-related molecules is compared to the expected differential expression for each liver fibrosis-related molecule for a subject with liver fibrosis to determine whether the detected differential expressions indicate a diagnosis of liver fibrosis. In some embodiments, the level of differential expression required to prognose the development of liver fibrosis will vary from the level required to diagnose the presence of liver fibrosis. In one embodiment, the required differential expression of the at least two (e.g., at least 3, at least 4, at least 5, at least 6, at least 7, at least 8, at least 9, or at least 10, such as 2, 5, 10 or 15) liver fibrosis-related molecules for prognosis of liver fibrosis is smaller than that required for diagnosis. In certain embodiments, the time at which differential expression of the at least two (e.g., at least 3, at least 4, at least 5, at least 6, at least 7, at least 8, at least 9, or at least 10, such as 2, 5, 10 or 15) liver fibrosis-related molecules is measured is earlier for prognosis than for diagnosis. In various embodiments, differential expression is measured at least 10 days, at least 30 days, at least 90 days, at least 2 months, at least 3 months, at least 6 months, at least 1 year, at least 2 years, at least 3 years, at least 5 years or at least 10 years earlier for prognosis of liver fibrosis than for diagnosis.

In certain embodiments, the at least two (e.g., at least 3, at least 4, at least 5, at least 6, at least 7, at least 8, at least 9, or at least 10, such as 2, 5, 10 or 15) liver fibrosis-related molecules are selected for their suitability for prognosis. In some embodiments, the at least two (e.g., at least 3, at least 4, at least 5, at least 6, at least 7, at least 8, at least 9, or at least 10, such as 2, 5, 10 or 15) liver fibrosis-related molecules are selected for prognosis on the basis of their showing differential expression at an early time point as compared to non-selected proteins. Exemplary markers that can be used for prognosis include VTN, LUM, and F10. In some embodiments, the at least two (e.g., at least 3, at least 4, at least 5, at least 6, at least 7, at least 8, at least 9, or at least 10, such as 2, 5, 10 or 15) liver fibrosis-related molecules are selected for diagnosis also on the basis of their showing differential expression at an earlier time point as compared to non-selected proteins. In various embodiments, a significant differential expression in the amount of the at least two (e.g., at least 3, at least 4, at least 5, at least 6, at least 7, at least 8, at least 9, or at least 10, such as 2, 5, 10 or 15) liver fibrosis related molecules in the serum or plasma (or other sample) of a subject compared to the amount of the same liver fibrosis related molecule found in a control is at least at a 1.1-fold, at least 1.2 fold, at least 1.5 fold, at least 2-fold, at least 3-fold, at least 4-fold or greater increase or decrease. Substantial differential expression, including overexpression or underexpression, of the at least two (e.g., at least 3, at least 4, at least 5, at least 6, at least 7, at least 8, at least 9, or at least 10, such as 2, 5, 10 or 15) or more liver fibrosis related molecule(s) can be indicative of the presence of liver fibrosis such as fast-progressing liver fibrosis or slow-progressing liver fibrosis.

In some examples, the control is a reference value or range of values representing a quantitative or qualitative amount of expression (e.g., protein, peptide, or nucleic acid) expected in a subject without liver fibrosis. In certain embodiments, the control is a predicted reference value or range of values representing a quantitative or qualitative amount of expression (e.g., protein, peptide, or nucleic acid) expected for the subject based on his/her personal characteristics such as health status, genetics and demographic information. In certain embodiments, the detected expression (e.g., protein, peptide, or nucleic acid) for a subject is compared to the protein expression for a matched control subject such as a control subject without liver fibrosis or with non-progressing liver fibrosis. In some embodiments, the control is a reference value or range of values representing a quantitative or qualitative amount of protein expression expected in a subject with non-progressing liver fibrosis. In some embodiments, the control is a reference value or range of values representing a quantitative or qualitative amount of protein expression expected in a subject with slow-progressing liver fibrosis. In some embodiments, the control is a reference value or range of values representing a quantitative or qualitative amount of protein expression expected in a subject with fast-progressing liver fibrosis. In some embodiments, the control is a reference value or range of values representing a quantitative or qualitative amount of protein expression expected in a subject without liver fibrosis but with HCV or HBV infection.

Tables 1-3 and 5-6 below provide differential expression information for specific liver fibrosis-related proteins. In one example, at least 10 or at least 15 of the peptides shown in any of SEQ ID NOS: 1-5544 are detected as an indication of protein expression. One skilled in the art will appreciate that as an alternative to detecting protein expression, expression of the corresponding nucleic acid molecule can be detected. In some examples, expression of the plurality of proteins or nucleic acids is detected simultaneously or contemporaneously in a sample. Furthermore, due to multiplexing technologies, one will appreciate that multiple samples, for example from different subjects, can be analyzed simultaneously or contemporaneously.

Table 1 provides directionality and relative amounts of differential expression detected for liver fibrosis-related proteins in subjects having post-transplant liver fibrosis (fast-progressing or slow-progressing) relative to matched controls representing the amount of protein expression in a subject with non-progressing liver fibrosis. Differential expression for the proteins ranged from 1.1-fold to more than 3-fold. Thus, expression of two or more of the liver fibrosis-related proteins (or corresponding peptides or nucleic acid molecules) in Table 1 can be used to diagnose or prognose liver fibrosis in a subject, such as by detecting expression of at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 31, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, at least 60, at least 61, at least 62, at least 63, at least 64, at least 65, at least 66, at least 67, at least 68, at least 69, at least 70, at least 71, at least 72, at least 73, at least 74, at least 75, at least 76, at least 77, at least 78, at least 79, at least 80, at least 81, at least 82, at least 83, at least 84, at least 85, at least 86, at least 87, at least 88, at least 89, at least 90, at least 91, at least 92, at least 93, at least 94, at least 95, at least 96, at least 97, at least 98, at least 99, at least 100, at least 101, at least 102, at least 103, at least 104, at least 105, at least 106, at least 107, at least 108, at least 109, at least 110, at least 111, at least 112, at least 113, at least 114, at least 115, at least 116, at least 117, at least 118, at least 119, at least 120, at least 121, at least 122, at least 123, at least 124, at least 125, at least 126, at least 127, at least 128, at least 129, at least 130, at least 131, at least 132, at least 133, at least 134, at least 135, or all 136 of the proteins (or corresponding peptides or nucleic acid molecules) in Table 1. For example, if at least two of the liver fibrosis-related molecules in Table 1 (such as at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 31, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, at least 60, at least 61, at least 62, at least 63, at least 64, at least 65, at least 66, at least 67, at least 68, at least 69, at least 70, at least 71, at least 72, at least 73, at least 74, at least 75, at least 76, at least 77, at least 78, at least 79, at least 80, at least 81, at least 82, at least 83, at least 84, at least 85, at least 86, at least 87, at least 88, at least 89, at least 90, at least 91, at least 92, at least 93, at least 94, at least 95, at least 96, at least 97, at least 98, at least 99, at least 100, at least 101, at least 102, at least 103, at least 104, at least 105, at least 106, at least 107, at least 108, at least 109, at least 110, at least 111, at least 112, at least 113, at least 114, at least 115, at least 116, at least 117, at least 118, at least 119, at least 120, at least 121, at least 122, at least 123, at least 124, at least 125, at least 126, at least 127, at least 128, at least 129, at least 130, at least 131, at least 132, at least 133, at least 134, at least 135, or all 136 of the proteins) show the relative amount and direction of differential expression in the test sample, relative to a control (such as an amount of protein expression expected in a subject or population of subjects having non-progressing liver fibrosis), this results in a diagnosis of liver fibrosis, or a prognosis that the subject will develop liver fibrosis in the future.

Also shown in Table 1 is that 63 of the proteins also exhibited differential expression in non-transplant patients with liver fibrosis (see Table 5). Additionally, after excluding 4 proteins which decrease in SP, but increase in FP, >91% are observed with common abundance directionality with the non-transplant results (Table 12), providing strong orthogonal validation of the proteins based upon both transplant and non-transplant patients. 26 proteins (Ig kappa chain V-III region VG, Ig kappa chain V-III region HAH, Ig lambda chain V-III region LOI, IGHA1, IGHG1, IGHG2, IGKC, IGKV1-5, IGLC1, FCGR3A, C7, HBB, LGALS3BP, MBL2, SERPINA1, SHBG, CNDP1, CNDP1, ALB, APOC3, C4A, FGA, ORM1, ORM2, TTR, and FN1) showed at least a 1.5-fold change in both slow- and fast-progressing liver fibrosis, and 10 proteins (Ig kappa chain V-III region VG, Ig kappa chain V-III region HAH, Ig lambda chain V-III region LOI, IGHA1, IGHG1, IGHG2, IGKV1-5, SERPINA1, APOC3, and TTR) showed more than 2-fold differential expression in both slow- and fast-progressing liver fibrosis. Thus in some examples, these 26 proteins or 10 proteins are used in the methods and systems provided herein to diagnose or prognose liver fibrosis.

TABLE 1

Changes in 136 Liver Fibrosis Related Proteins in Slow- and/or Fast-Progressing Liver Fibrosis relative to matched controls representing protein expression in a subject with non-progressing liver fibrosis

| Gene | Protein and UniProt Accession Number | Up-regulated | Down-regulated | Fold-Change vs. Control |
|---|---|---|---|---|
| Proteins significantly upregulated in the Slow and Fast Progressors (SP & FP) compared to their matched controls | | | | |
| PTPRG | P23470 Receptor-type tyrosine-protein phosphatase gamma | X | | At least 1.2-fold |
| QSOX1 | O00391 Sulfhydryl oxidase 1 | X | | At least 1.4-fold |
| GPX3 | P22352 Glutathione peroxidase 3 | X | | At least 1.2-fold |
| . | P04433 Ig kappa chain V-III region VG | X | | At least 2-fold |
| . | P18135 Ig kappa chain V-III region HAH | X | | At least 2.2-fold |
| . | P80748 Ig lambda chain V-III region LOI | X | | At least 2.1-fold |
| IGHA1 | P01876 Ig alpha-1 chain C region | X | | At least 2.8-fold |
| IGHG1 | P01857 Ig gamma-1 chain C region | X | | At least 2.2-fold |
| IGHG2 | P01859 Ig gamma-2 chain C region | X | | At least 2.4-fold |
| IGHM | P01871 Ig mu chain C region | X | | At least 1.6-fold |
| IGKC | P01834 Ig kappa chain C region | X | | At least 1.8-fold |
| IGKV1-5 | P01602 Ig kappa chain V-I region HK102 | X | | At least 2-fold |
| IGLC1 | P01842 Ig lambda chain C regions | X | | At least 1.8-fold |
| FCGR3A | P08637 Low affinity immunoglobulin gamma Fc region receptor III-A | X | | At least 1.5-fold |
| A2M | P01023 Alpha-2-macroglobulin | X | | At least 1.4-fold |
| ACTB | Q96HG5 Actin, cytoplasmic 1 | X | | At least 1.2-fold |
| AFM | P43652 Afamin | X | | At least 1.3-fold |

TABLE 1-continued

Changes in 136 Liver Fibrosis Related Proteins in Slow- and/or Fast-Progressing Liver Fibrosis relative to matched controls representing protein expression in a subject with non-progressing liver fibrosis

| Gene | Protein and UniProt Accession Number | Up-gulated | Down-regulated | Fold-Change vs. Control |
|---|---|---|---|---|
| AHSG | P02765 Alpha-2-HS-glycoprotein | X | | At least 1.3-fold |
| ALCAM | Q13740 CD166 antigen | X | | At least 1.3-fold |
| APOB | Q13787 Apolipoprotein B-100 | X | | At least 1.2-fold |
| APOE | P02649 Apolipoprotein E | X | | At least 1.3-fold |
| C7 | P10643 Complement component C7 | X | | At least 1.8-fold |
| CLU | P10909 Clusterin | X | | At least 1.2-fold |
| ECM1 | Q8IZ60 Extracellular matrix protein 1 | X | | At least 1.3-fold |
| HBB | Q549N7 Hemoglobin subunit beta | X | | At least 1.5-fold |
| ITIH3 | Q06033 Inter-alpha-trypsin inhibitor heavy chain H3 | X | | At least 1.2-fold |
| LGALS3BP | Q08380 Galectin-3-binding protein | X | | At least 1.5-fold |
| MBL2 | P11226 Mannose-binding protein C | X | | At least 1.6-fold |
| SELL | P14151 L-selectin | X | | At least 1.2-fold |
| SERPINA1 | Q86U18 Alpha-1-antitrypsin | X | | At least 3-fold |
| SERPINA6 | P08185 Corticosteroid-binding globulin | X | | At least 1.2-fold |
| SHBG | P04278 Sex hormone-binding globulin | X | | At least 1.5-fold |
| VCAM1 | P19320 Vascular cell adhesion protein 1 | X | | At least 1.3-fold |
| VWF | P04275 von Willebrand factor | X | | At least 1.3-fold |

Proteins significantly downregulated in the Slow and Fast Progressors (SP & FP) compared to their matched controls

| Gene | Protein and UniProt Accession Number | Up-gulated | Down-regulated | Fold-Change vs. Control |
|---|---|---|---|---|
| F2 | P00734 Prothrombin | | X | At least 1.2-fold |
| CFB | Q9BX92 Complement factor B | | X | At least 1.1-fold |
| CFI | P05156 Complement factor I | | X | At least 1.1-fold |
| C1S | Q9UCV4 Complement C1s subcomponent | | X | At least 1.2-fold |
| C1R | P00736 Complement C1r subcomponent | | X | At least 1.2-fold |
| KLKB1 | P03952 Plasma kallikrein | | X | At least 1.3-fold |
| F11 | P03951 Coagulation factor XI | | X | At least 1.3-fold |
| F9 | P00740 Coagulation factor IX | | X | At least 1.2-fold |
| CNDP1 | Q96KN2 Beta-Ala-His dipeptidase | | X | At least 1.8-fold |
| BCHE | P06276 Cholinesterase | | X | At least 1.3-fold |
| ALB | Q9P157 Serum albumin | | X | At least 1.9-fold |
| APCS | P02743 Serum amyloid P-component | | X | At least 1.3-fold |
| APOA4 | P06727 Apolipoprotein A-IV | | X | At least 1.2-fold |
| APOC3 | P02656 Apolipoprotein C-III | | X | At least 2.2-fold |
| APOH | P02749 Beta-2-glycoprotein 1 | | X | At least 1.3-fold |
| AZGP1 | P25311 Zinc-alpha-2-glycoprotein | | X | At least 1.2-fold |
| C4A | Q5JQM8 Complement C4-A | | X | At least 1.5-fold |
| C6 | P13671 Complement component C6 | | X | At least 1.2-fold |
| C8A | P07357 Complement component C8 alpha chain | | X | At least 1.3-fold |
| C8B | P07358 Complement component C8 beta chain | | X | At least 1.3-fold |
| C8G | P07360 Complement component C8 gamma chain | | X | At least 1.2-fold |
| C9 | P02748 Complement component C9 | | X | At least 1.2-fold |
| FGA | P02671 Fibrinogen alpha chain | | X | At least 1.8-fold |
| HPX | P02790 Hemopexin | | X | At least 1.2-fold |
| HRG | P04196 Histidine-rich glycoprotein | | X | At least 1.3-fold |
| IGFALS | P35858 Insulin-like growth factor-binding protein complex acid labile subunit | | X | At least 1.3-fold |
| ITIH1 | P19827 Inter-alpha-trypsin inhibitor heavy chain H1 | | X | At least 1.3-fold |
| ITIH2 | P19823 Inter-alpha-trypsin inhibitor heavy chain H2 | | X | At least 1.1-fold |
| ITIH4 | Q14624 Inter-alpha-trypsin inhibitor heavy chain H4 | | X | At least 1.1-fold |
| ORM1 | P02763 Alpha-1-acid glycoprotein 1 | | X | At least 1.8-fold |
| ORM2 | P19652 Alpha-1-acid glycoprotein 2 | | X | At least 1.5-fold |
| PRG4 | Q92954 Proteoglycan 4 | | X | At least 1.2-fold |
| RBP4 | P02753 Retinol-binding protein 4 | | X | At least 1.1-fold |
| SERPINA3 | Q6NSC9 Alpha-1-antichymotrypsin | | X | At least 1.1-fold |
| SERPINC1 | Q9UC78 Antithrombin-III | | X | At least 1.1-fold |
| SERPIND1 | P05546 Heparin cofactor 2 | | X | At least 1.2-fold |
| TTR | P02766 Transthyretin | | X | At least 2.2-fold |

TABLE 1-continued

Changes in 136 Liver Fibrosis Related Proteins in Slow- and/or Fast-Progressing Liver Fibrosis relative to matched controls representing protein expression in a subject with non-progressing liver fibrosis

| Gene | Protein and UniProt Accession Number | Up-regulated | Down-regulated | Fold-Change vs. Control |
|---|---|---|---|---|
| *Proteins showing opposing significant changes in the Slow and Fast Progressors (SP & FP) compared to matched controls* | | | | |
| F10 | P00742 Coagulation factor X | X | X | Slow-Progressing: At least 1.2-fold (decrease) Fast-Progressing: At least 1.2 fold (increase) |
| FN1 | Q9HAP3 Fibronectin | X | X | Slow-Progressing: At least 1.5-fold (decrease) Fast-Progressing: At least 1.5-fold (increase) |
| C5 | P01031 Complement C5 | X | X | Slow-Progressing: At least 1.1-fold (increase) Fast-Progressing: At least 1.2-fold (increase) |
| SERPINA4 | P29622 Kallistatin | X | X | Slow-Progressing: At least 1.2-fold (decrease) Fast-Progressing: At least 1.3-fold (increase) |
| VTN | P04004 Vitronectin | X | X | Slow-Progressing: At least 1.1-fold (decrease) Fast-Progressing: At least 1.2-fold (increase) |
| LUM | P51884 Lumican | X | X | Slow-Progressing: At least 2.6-fold (decrease) Fast-Progressing: At least 1.1-fold (increase) |
| *Proteins significantly increasing/decreasing only in Slow Progressors (SP) compared to their matched controls* | | | | |
| HBA1 | P69905 Hemoglobin subunit alpha | X | | At least 2.1-fold |
| SERPING1 | Q96FE0 Plasma protease C1 inhibitor | X | | At least 1.4-fold |
| . | P01594 Ig kappa chain V-I region AU | X | | At least 3-fold |
| . | P01614 Ig kappa chain V-II region Cum | X | | At least 3.2-fold |
| IGKV4-1 | P06312 Ig kappa chain V-IV region | X | | At least 3.3-fold |
| PGLYRP2 | Q96PD5 N-acetylmuramoyl-L-alanine amidase | | X | At least 1.2 fold |
| BTD | P43251 Biotinidase | | X | At least 1.2 fold |
| PLG | P00747 Plasminogen | | X | At least 1.1 fold |
| PROC | P04070 Vitamin K-dependent protein C | | X | At least 1.6 fold |
| C1RL | Q9NZP8 Complement C1r subcomponent-like protein | | X | At least 1.2 fold |
| CPN1 | P15169 Carboxypeptidase N catalytic chain | | X | At least 1.1 fold |
| CPB2 | Q96IY4 Carboxypeptidase B2 | | X | At least 1.2 fold |
| APOA1 | P02647 Apolipoprotein A-I* | | X | At least 1.5 fold |
| C4B | Q9UIP5 Complement C4-B | | X | At least 1.5 fold |
| GC | P02774 Vitamin D-binding protein | | X | At least 1.1 fold |
| GP5 | P40197 Platelet glycoprotein V | | X | At least 1.2 fold |

TABLE 1-continued

Changes in 136 Liver Fibrosis Related Proteins in Slow- and/or Fast-Progressing Liver Fibrosis relative to matched controls representing protein expression in a subject with non-progressing liver fibrosis

| Gene | Protein and UniProt Accession Number | Up-regulated | Down-regulated | Fold-Change vs. Control |
|---|---|---|---|---|
| HP | P00738 Haptoglobin | | X | At least 1.4 fold |
| IGFBP3 | P17936 Insulin-like growth factor-binding protein 3* | | X | At least 1.3 fold |
| KNG1 | P01042 Kininogen-1 | | X | At least 1.3 fold |
| PROS1 | P07225 Vitamin K-dependent protein S | | X | At least 1.3 fold |
| SERPINA10 | Q9UK55 Protein Z-dependent protease inhibitor | | X | At least 1.4 fold |
| SERPINF1 | P36955 Pigment epithelium-derived factor | | X | At least 1.2 fold |
| SERPINF2 | P08697 Alpha-2-antiplasmin | | X | At least 1.1 fold |
| THBS1 | P07996 Thrombospondin-1 | | X | At least 1.4 fold |
| Proteins significantly changing only in Fast Progressors (FP) compared to their matched controls | | | | |
| PTGDS | P41222 Prostaglandin-H2 D-isomerase | X | | At least 1.2-fold |
| CA1 | P00915 Carbonic anhydrase 1 | X | | At least 2.1-fold |
| ALDOB | P05062 Fructose-bisphosphate aldolase B | X | | At least 1.7-fold |
| C2 | P06681 Complement C2 | X | | At least 1.2-fold |
| F12 | P00748 Coagulation factor XII | X | | At least 1.2-fold |
| MASP2 | Q9H498 Mannan-binding lectin serine protease 2 | X | | At least 1.2-fold |
| HABP2 | Q14520 Hyaluronan-binding protein 2 | X | | At least 1.4-fold |
| ANPEP | P15144 Aminopeptidase N | X | | At least 1.4-fold |
| ENPP2 | Q9UCR2 Ectonucleotide pyrophosphatase/phosphodiesterase family member 2 | X | | At least 1.5-fold |
| CP | P00450 Ceruloplasmin | X | | At least 1.1-fold |
| PRDX2 | P32119 Peroxiredoxin-2 | X | | At least 1.6-fold |
| A1BG | P04217 Alpha-1B-glycoprotein* | X | | At least 1.1-fold |
| TGFBI | Q53XM1 Transforming growth factor-beta-induced protein ig-h3 | X | | At least 1.4-fold |
| CD14 | P08571 Monocyte differentiation antigen CD14 | X | | At least 1.3-fold |
| C3 | P01024 Complement C3 | X | | At least 1.3-fold |
| ENG | P17813 Endoglin | X | | At least 1.3-fold |
| PROCR | Q9UNN8 Endothelial protein C receptor | X | | At least 1.2-fold |
| FCGBP | Q9Y6R7 IgGFc-binding protein | X | | At least 1.4-fold |
| FCN3 | O75636 Ficolin-3 | X | | At least 1.3-fold |
| FETUB | Q9UGM5 Fetuin-B | X | | At least 1.3-fold |
| MST1 | P26927 Hepatocyte growth factor-like protein | X | | At least 1.4-fold |
| MCAM | P43121 Cell surface glycoprotein MUC18 | X | | At least 1.2-fold |
| NRP1 | O14786 Neuropilin-1 | X | | At least 1.3-fold |
| SPP2 | Q13103 Secreted phosphoprotein 24 | X | | At least 1.4-fold |
| SERPINA7 | P05543 Thyroxine-binding globulin | X | | At least 1.5-fold |
| VASN | Q6EMK4 Vasorin | X | | At least 1.2-fold |
| COL18A1 | Q96T70 Collagen alpha-1(XVIII) chain | X | | At least 1.8-fold |
| PVR | P15151 Poliovirus receptor | X | | At least 1.6-fold |
| APOA2 | P02652 Apolipoprotein A-II | X | | At least 1.8-fold |
| PI16 | Q6UXB8 Peptidase inhibitor 16 | X | | At least 1.9-fold |
| H6PD | O95479 GDH/6PGL endoplasmic bifunctional protein | | X | At least 1.5-fold |
| AGT | P01019 Angiotensinogen | | X | At least 1.3-fold |
| CFH | Q9NU86 Complement factor H | | X | At least 1.2-fold |
| CRP | P02741 C-reactive protein | | X | At least 1.6-fold |
| GSN | P06396 Gelsolin | | X | At least 1.3-fold |

Table 2 provides directionality and relative amounts of differential expression detected for liver fibrosis-related proteins in subjects having post-transplant liver fibrosis which showed differential expression in fast-progressing liver fibrosis relative to matched controls representing the amount of protein expression in a subject with non-progressing liver fibrosis. Differential expression for the proteins ranged from 1.1-fold to more than 3-fold. The fold-change observed for those proteins showing differential expression in fast-progressing liver fibrosis is also provided in Table 2. A large group of the proteins (40) showed more than a 1.5-fold change in fast-progressing liver fibrosis, and 13 proteins showed more than a 2-fold change. Thus in some examples, these 40 proteins or 13 proteins are used in the methods and systems provided herein to diagnose or prognose fast-progressing liver fibrosis. 41 of the proteins either do not show differential expression in slow-progressing liver fibrosis or show differential expression in the opposite direction. Of these 41 proteins, 12 had more than a 1.5-fold change in fast-progressing liver fibrosis. Thus in some examples, these 12 proteins are used in the methods and systems provided herein to diagnose or prognose fast-progressing liver fibrosis.

Thus, expression of two or more of the liver fibrosis-related proteins (or corresponding peptides or nucleic acid molecules) in Table 2 can be used to diagnose or prognose fast-progressing liver fibrosis in a subject, such as by detecting expression of at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 31, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, at least 60, at least 61, at least 62, at least 63, at least 64, at least 65, at least 66, at least 67, at least 68, at least 69, at least 70, at least 71, at least 72, at least 73, at least 74, at least 75, at least 76, at least 77, at least 78, at least 79, at least 80, at least 81, at least 82, at least 83, at least 84, at least 85, at least 86, at least 87, at least 88, at least 89, at least 90, at least 91, at least 92, at least 93, at least 94, at least 95, at least 96, at least 97, at least 98, at least 99, at least 100, at least 101, at least 102, at least 103, at least 104, at least 105, at least 106, at least 107, at least 108, at least 109, at least 110, at least 111, or all 112 of the proteins (or corresponding peptides or nucleic acid molecules) in Table 2. For example, if at least two of the liver fibrosis-related molecules in Table 2 (such as at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 31, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, at least 60, at least 61, at least 62, at least 63, at least 64, at least 65, at least 66, at least 67, at least 68, at least 69, at least 70, at least 71, at least 72, at least 73, at least 74, at least 75, at least 76, at least 77, at least 78, at least 79, at least 80, at least 81, at least 82, at least 83, at least 84, at least 85, at least 86, at least 87, at least 88, at least 89, at least 90, at least 91, at least 92, at least 93, at least 94, at least 95, at least 96, at least 97, at least 98, at least 99, at least 100, at least 101, at least 102, at least 103, at least 104, at least 105, at least 106, at least 107, at least 108, at least 109, at least 110, at least 111, or all 112 of the proteins) show the relative amount and direction of differential expression in the test sample, relative to a control (such as an amount of protein expression expected in a subject or population of subjects having non-progressing liver fibrosis), this results in a diagnosis of fast-progressing liver fibrosis, or a prognosis that the subject will develop a fast-progressing liver fibrosis in the future.

Similarly, expression of two or more of the liver fibrosis-related peptides in any of SEQ ID NOS: 1281-2633 can be used to diagnose or prognose fast-progressing liver fibrosis in a subject. Thus, expression of 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 701, 702, 703, 704, 705, 706, 707, 708, 709, 710, 711, 712, 713, 714, 715, 716, 717, 718, 719, 720, 721, 722, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 847, 848, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 903, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, 950, 951, 952, 953, 954, 955, 956, 957, 958, 959, 960, 961, 962, 963, 964, 965, 966, 967, 968, 969, 970, 971, 972, 973, 974, 975, 976, 977, 978, 979, 980, 981, 982, 983, 984, 985, 986, 987, 988, 989, 990, 991, 992, 993, 994, 995, 996, 997, 998, 999, 1000, 1001, 1002, 1003, 1004, 1005, 1006, 1007, 1008, 1009, 1010, 1011, 1012, 1013, 1014, 1015, 1016, 1017, 1018, 1019, 1020, 1021, 1022, 1023, 1024, 1025, 1026, 1027, 1028, 1029, 1030, 1031, 1032, 1033, 1034, 1035, 1036, 1037, 1038, 1039, 1040, 1041, 1042, 1043, 1044, 1045, 1046, 1047, 1048, 1049, 1050, 1051, 1052, 1053, 1054, 1055, 1056, 1057, 1058, 1059, 1060, 1061, 1062, 1063, 1064, 1065, 1066, 1067, 1068, 1069, 1070, 1071, 1072, 1073, 1074, 1075, 1076, 1077, 1078, 1079, 1080, 1081, 1082, 1083, 1084, 1085, 1086, 1087, 1088, 1089, 1090, 1091, 1092, 1093, 1094, 1095, 1096, 1097, 1098, 1099, 1100, 1101, 1102, 1103, 1104, 1105, 1106, 1107, 1108, 1109, 1110, 1111, 1112, 1113, 1114, 1115, 1116, 1117, 1118, 1119, 1120, 1121, 1122, 1123, 1124, 1125, 1126, 1127, 1128, 1129, 1130, 1131, 1132, 1133, 1134, 1135, 1136, 1137, 1138, 1139, 1140, 1141, 1142, 1143, 1144, 1145, 1146, 1147, 1148, 1149, 1150, 1151, 1152, 1153, 1154, 1155, 1156, 1157, 1158, 1159, 1160, 1161, 1162, 1163, 1164, 1165, 1166, 1167, 1168, 1169, 1170, 1171, 1172, 1173, 1174, 1175, 1176, 1177, 1178, 1179, 1180, 1181, 1182, 1183, 1184, 1185, 1186, 1187, 1188, 1189, 1190, 1191, 1192, 1193, 1194, 1195, 1196, 1197, 1198, 1199, 1200, 1201, 1202, 1203, 1204, 1205, 1206, 1207, 1208, 1209, 1210, 1211, 1212, 1213, 1214, 1215, 1216, 1217, 1218, 1219, 1220, 1221, 1222, 1223, 1224, 1225, 1226, 1227, 1228, 1229, 1230, 1231, 1232, 1233, 1234, 1235, 1236, 1237, 1238, 1239, 1240, 1241, 1242, 1243, 1244, 1245, 1246, 1247, 1248, 1249, 1250, 1251, 1252, 1253, 1254, 1255, 1256, 1257, 1258, 1259, 1260, 1261, 1262, 1263, 1264, 1265, 1266, 1267, 1268, 1269, 1270, 1271, 1272, 1273, 1274, 1275, 1276, 1277, 1278, 1279, 1280, 1281, 1282, 1283, 1284, 1285, 1286, 1287, 1288, 1289, 1290, 1291, 1292, 1293, 1294, 1295, 1296, 1297, 1298, 1299, 1300, 1301, 1302, 1303, 1304, 1305, 1306, 1307, 1308, 1309, 1310, 1311, 1312, 1313, 1314, 1315, 1316, 1317, 1318, 1319, 1320, 1321, 1322, 1323, 1324, 1325, 1326, 1327, 1328, 1329, 1330, 1331, 1332, 1333, 1334, 1335, 1336, 1337, 1338, 1339, 1340, 1341, 1342, 1343, 1344, 1345, 1346, 1347, 1348, 1349, 1350, 1351, 1352, or 1353 of the liver fibrosis-related peptides in any of SEQ ID NOS: 1281, 1282, 1283, 1284, 1285, 1286, 1287, 1288, 1289, 1290, 1291, 1292, 1293, 1294, 1295, 1296, 1297, 1298, 1299, 1300, 1301, 1302, 1303, 1304, 1305, 1306, 1307, 1308, 1309, 1310, 1311, 1312, 1313, 1314, 1315, 1316, 1317, 1318, 1319, 1320, 1321, 1322, 1323, 1324, 1325, 1326, 1327, 1328, 1329, 1330, 1331, 1332, 1333, 1334, 1335, 1336, 1337, 1338, 1339, 1340, 1341, 1342, 1343, 1344, 1345, 1346, 1347, 1348, 1349, 1350, 1351, 1352, 1353, 1354, 1355, 1356, 1357, 1358, 1359, 1360, 1361, 1362, 1363, 1364, 1365, 1366, 1367, 1368, 1369, 1370, 1371, 1372, 1373, 1374, 1375, 1376, 1377, 1378, 1379, 1380, 1381, 1382, 1383, 1384, 1385, 1386, 1387, 1388, 1389, 1390, 1391, 1392, 1393, 1394, 1395, 1396, 1397, 1398, 1399, 1400, 1401, 1402, 1403, 1404, 1405, 1406, 1407, 1408, 1409, 1410, 1411, 1412, 1413, 1414, 1415, 1416, 1417, 1418, 1419, 1420, 1421, 1422, 1423, 1424, 1425, 1426, 1427, 1428, 1429, 1430, 1431, 1432, 1433, 1434, 1435, 1436, 1437, 1438, 1439, 1440, 1441, 1442, 1443, 1444, 1445, 1446, 1447, 1448, 1449, 1450, 1451, 1452, 1453, 1454, 1455, 1456, 1457, 1458, 1459, 1460, 1461, 1462, 1463, 1464, 1465, 1466, 1467, 1468, 1469, 1470, 1471, 1472, 1473, 1474, 1475, 1476, 1477, 1478, 1479, 1480, 1481, 1482, 1483, 1484, 1485, 1486, 1487, 1488, 1489, 1490, 1491, 1492, 1493, 1494, 1495, 1496, 1497, 1498, 1499, 1500, 1501, 1502, 1503, 1504, 1505, 1506, 1507, 1508, 1509, 1510, 1511, 1512, 1513, 1514, 1515, 1516, 1517, 1518, 1519, 1520, 1521, 1522, 1523, 1524, 1525, 1526, 1527, 1528, 1529, 1530, 1531, 1532, 1533, 1534, 1535, 1536, 1537, 1538, 1539, 1540, 1541, 1542, 1543, 1544, 1545, 1546, 1547, 1548, 1549, 1550, 1551, 1552, 1553, 1554, 1555, 1556, 1557, 1558, 1559, 1560, 1561, 1562, 1563, 1564, 1565, 1566, 1567, 1568, 1569, 1570, 1571, 1572, 1573, 1574, 1575, 1576, 1577, 1578, 1579, 1580, 1581, 1582, 1583, 1584, 1585, 1586, 1587, 1588, 1589, 1590, 1591, 1592, 1593, 1594, 1595, 1596, 1597, 1598, 1599, 1600, 1601, 1602, 1603, 1604, 1605, 1606, 1607, 1608, 1609, 1610, 1611, 1612, 1613, 1614, 1615, 1616, 1617, 1618, 1619, 1620, 1621, 1622, 1623, 1624, 1625, 1626, 1627, 1628, 1629, 1630, 1631, 1632, 1633, 1634, 1635, 1636, 1637, 1638, 1639, 1640, 1641, 1642, 1643, 1644, 1645, 1646, 1647, 1648, 1649, 1650, 1651, 1652, 1653, 1654, 1655, 1656, 1657, 1658, 1659, 1660, 1661, 1662, 1663, 1664, 1665, 1666, 1667, 1668, 1669, 1670, 1671, 1672, 1673, 1674, 1675, 1676, 1677, 1678, 1679, 1680, 1681, 1682, 1683, 1684, 1685, 1686, 1687, 1688, 1689, 1690, 1691, 1692, 1693, 1694, 1695, 1696, 1697, 1698, 1699, 1700, 1701, 1702, 1703, 1704, 1705, 1706, 1707, 1708, 1709, 1710, 1711, 1712, 1713, 1714, 1715, 1716, 1717, 1718, 1719, 1720, 1721, 1722, 1723, 1724, 1725, 1726, 1727, 1728, 1729, 1730, 1731, 1732, 1733, 1734, 1735, 1736, 1737, 1738, 1739, 1740, 1741, 1742, 1743, 1744, 1745, 1746, 1747, 1748, 1749, 1750, 1751, 1752, 1753, 1754, 1755, 1756, 1757, 1758, 1759, 1760, 1761, 1762, 1763, 1764, 1765, 1766, 1767, 1768, 1769, 1770, 1771, 1772, 1773, 1774, 1775, 1776, 1777, 1778, 1779, 1780, 1781, 1782, 1783, 1784, 1785, 1786, 1787, 1788, 1789, 1790, 1791, 1792, 1793, 1794, 1795, 1796, 1797, 1798, 1799, 1800, 1801, 1802, 1803, 1804, 1805, 1806, 1807, 1808, 1809, 1810, 1811, 1812, 1813, 1814, 1815, 1816, 1817, 1818, 1819, 1820, 1821, 1822, 1823, 1824, 1825, 1826, 1827, 1828, 1829, 1830, 1831, 1832, 1833, 1834, 1835, 1836, 1837, 1838, 1839, 1840, 1841, 1842, 1843, 1844, 1845, 1846, 1847, 1848, 1849, 1850, 1851, 1852, 1853, 1854, 1855, 1856, 1857, 1858, 1859, 1860, 1861, 1862, 1863, 1864, 1865, 1866, 1867, 1868, 1869, 1870, 1871, 1872, 1873, 1874, 1875, 1876, 1877, 1878, 1879, 1880, 1881, 1882, 1883, 1884, 1885, 1886, 1887, 1888, 1889, 1890, 1891, 1892, 1893, 1894, 1895, 1896, 1897, 1898, 1899, 1900, 1901, 1902, 1903, 1904, 1905, 1906, 1907, 1908, 1909, 1910, 1911, 1912, 1913, 1914, 1915, 1916, 1917, 1918, 1919, 1920, 1921, 1922, 1923, 1924, 1925, 1926, 1927, 1928, 1929, 1930, 1931, 1932, 1933, 1934, 1935, 1936, 1937, 1938, 1939, 1940, 1941, 1942, 1943, 1944, 1945, 1946, 1947, 1948, 1949, 1950, 1951, 1952, 1953, 1954, 1955, 1956, 1957, 1958, 1959, 1960, 1961, 1962, 1963, 1964, 1965, 1966, 1967, 1968, 1969, 1970, 1971, 1972, 1973, 1974, 1975, 1976, 1977, 1978, 1979, 1980, 1981, 1982, 1983, 1984, 1985, 1986, 1987, 1988, 1989, 1990, 1991, 1992, 1993, 1994, 1995, 1996, 1997, 1998, 1999, 2000, 2001, 2002, 2003, 2004, 2005, 2006, 2007, 2008, 2009, 2010, 2011, 2012, 2013, 2014, 2015, 2016, 2017, 2018, 2019, 2020, 2021, 2022, 2023, 2024, 2025, 2026, 2027, 2028, 2029, 2030, 2031, 2032, 2033, 2034, 2035, 2036, 2037, 2038, 2039, 2040, 2041, 2042, 2043, 2044, 2045, 2046, 2047, 2048, 2049, 2050, 2051, 2052, 2053, 2054, 2055, 2056, 2057, 2058, 2059, 2060, 2061, 2062, 2063, 2064, 2065, 2066, 2067, 2068, 2069, 2070, 2071, 2072, 2073, 2074, 2075, 2076, 2077, 2078, 2079, 2080, 2081, 2082, 2083, 2084, 2085, 2086, 2087, 2088, 2089, 2090, 2091, 2092, 2093, 2094, 2095, 2096, 2097, 2098, 2099, 2100, 2101, 2102, 2103, 2104, 2105, 2106, 2107, 2108, 2109, 2110, 2111, 2112, 2113, 2114, 2115, 2116, 2117, 2118, 2119, 2120, 2121, 2122, 2123, 2124, 2125, 2126, 2127, 2128, 2129, 2130, 2131, 2132, 2133, 2134, 2135, 2136, 2137, 2138, 2139, 2140, 2141, 2142, 2143, 2144, 2145, 2146, 2147, 2148, 2149, 2150, 2151, 2152, 2153, 2154, 2155, 2156, 2157, 2158, 2159, 2160, 2161, 2162, 2163, 2164, 2165, 2166, 2167, 2168, 2169, 2170, 2171, 2172, 2173, 2174, 2175, 2176, 2177, 2178, 2179, 2180, 2181, 2182, 2183, 2184, 2185, 2186, 2187, 2188, 2189, 2190, 2191, 2192, 2193, 2194, 2195, 2196, 2197, 2198, 2199, 2200, 2201, 2202, 2203, 2204, 2205, 2206, 2207, 2208, 2209, 2210, 2211, 2212, 2213, 2214, 2215, 2216, 2217, 2218, 2219, 2220, 2221, 2222, 2223, 2224, 2225, 2226, 2227, 2228, 2229, 2230, 2231, 2232, 2233, 2234, 2235, 2236, 2237, 2238, 2239, 2240, 2241, 2242, 2243, 2244, 2245, 2246, 2247, 2248, 2249, 2250, 2251, 2252, 2253, 2254, 2255, 2256, 2257, 2258, 2259, 2260, 2261, 2262, 2263, 2264, 2265, 2266, 2267, 2268, 2269, 2270, 2271, 2272, 2273, 2274, 2275, 2276, 2277, 2278, 2279, 2280, 2281, 2282, 2283, 2284, 2285, 2286, 2287, 2288, 2289, 2290, 2291, 2292, 2293, 2294, 2295, 2296, 2297, 2298, 2299, 2300, 2301, 2302, 2303, 2304, 2305, 2306, 2307, 2308, 2309, 2310, 2311, 2312, 2313, 2314, 2315, 2316, 2317, 2318, 2319, 2320, 2321, 2322, 2323, 2324, 2325, 2326, 2327, 2328, 2329, 2330, 2331, 2332, 2333, 2334, 2335, 2336, 2337, 2338, 2339, 2340, 2341, 2342, 2343, 2344, 2345, 2346, 2347, 2348, 2349, 2350, 2351, 2352, 2353, 2354, 2355, 2356, 2357, 2358, 2359, 2360, 2361, 2362, 2363, 2364, 2365, 2366, 2367, 2368, 2369, 2370, 2371, 2372, 2373, 2374, 2375, 2376, 2377, 2378, 2379, 2380, 2381, 2382, 2383, 2384, 2385, 2386, 2387, 2388, 2389, 2390, 2391, 2392, 2393, 2394, 2395, 2396, 2397, 2398, 2399, 2400, 2401, 2402, 2403, 2404, 2405, 2406, 2407, 2408, 2409, 2410, 2411, 2412, 2413, 2414, 2415, 2416, 2417, 2418, 2419, 2420, 2421, 2422, 2423, 2424, 2425, 2426, 2427, 2428, 2429, 2430, 2431, 2432, 2433, 2434, 2435, 2436, 2437, 2438, 2439, 2440, 2441, 2442, 2443, 2444, 2445, 2446, 2447, 2448, 2449, 2450, 2451, 2452, 2453, 2454, 2455, 2456, 2457, 2458, 2459, 2460, 2461, 2462, 2463, 2464, 2465, 2466, 2467, 2468, 2469, 2470, 2471, 2472, 2473, 2474, 2475, 2476, 2477, 2478, 2479, 2480, 2481, 2482, 2483, 2484, 2485, 2486, 2487, 2488, 2489, 2490, 2491, 2492, 2493, 2494, 2495, 2496, 2497, 2498, 2499, 2500, 2501, 2502, 2503, 2504, 2505, 2506, 2507, 2508, 2509, 2510, 2511, 2512, 2513, 2514, 2515, 2516, 2517, 2518, 2519, 2520, 2521, 2522, 2523, 2524, 2525, 2526, 2527, 2528, 2529, 2530, 2531, 2532, 2533, 2534, 2535, 2536, 2537, 2538, 2539, 2540, 2541, 2542, 2543, 2544, 2545, 2546, 2547, 2548, 2549, 2550, 2551, 2552, 2553, 2554, 2555, 2556, 2557, 2558, 2559, 2560, 2561, 2562, 2563, 2564, 2565, 2566, 2567, 2568, 2569, 2570, 2571, 2572, 2573, 2574, 2575, 2576, 2577, 2578, 2579, 2580, 2581, 2582, 2583, 2584, 2585, 2586, 2587, 2588, 2589, 2590, 2591, 2592, 2593, 2594, 2595, 2596, 2597, 2598, 2599, 2600, 2601, 2602, 2603, 2604, 2605, 2606, 2607, 2608, 2609, 2610, 2611, 2612, 2613, 2614, 2615, 2616, 2617, 2618, 2619, 2620, 2621, 2622, 2623, 2624, 2625, 2626, 2627, 2628, 2629, 2630, 2631, 2632, and 2633, can be used to diagnose or prognose fast-progressing liver fibrosis in a subject. For example, if two or more of SEQ ID NOS: 1281-1869 are downregualted relative to a control (such as an amount of protein expression expected in a subject or population of subjects having non-progressing liver fibrosis), such as two or more of any of SEQ ID NOS: 1281, 1282, 1283, 1284, 1285, 1286, 1287, 1288, 1289, 1290, 1291, 1292, 1293, 1294, 1295, 1296, 1297, 1298, 1299, 1300, 1301, 1302, 1303, 1304, 1305, 1306, 1307, 1308, 1309, 1310, 1311, 1312, 1313, 1314, 1315, 1316, 1317, 1318, 1319, 1320, 1321, 1322, 1323, 1324, 1325, 1326, 1327, 1328, 1329, 1330, 1331, 1332, 1333, 1334, 1335, 1336, 1337, 1338, 1339, 1340, 1341, 1342, 1343, 1344, 1345, 1346, 1347, 1348, 1349, 1350, 1351, 1352, 1353, 1354, 1355, 1356, 1357, 1358, 1359, 1360, 1361, 1362, 1363, 1364, 1365, 1366, 1367, 1368, 1369, 1370, 1371, 1372, 1373, 1374, 1375, 1376, 1377, 1378, 1379, 1380, 1381, 1382, 1383, 1384, 1385, 1386, 1387, 1388, 1389, 1390, 1391, 1392, 1393, 1394, 1395, 1396, 1397, 1398, 1399, 1400, 1401, 1402, 1403, 1404, 1405, 1406, 1407, 1408, 1409, 1410, 1411, 1412, 1413, 1414, 1415, 1416, 1417, 1418, 1419, 1420, 1421, 1422, 1423, 1424, 1425, 1426, 1427, 1428, 1429, 1430, 1431, 1432, 1433, 1434, 1435, 1436, 1437, 1438, 1439, 1440, 1441, 1442, 1443, 1444, 1445, 1446, 1447, 1448, 1449, 1450, 1451, 1452, 1453, 1454, 1455, 1456, 1457, 1458, 1459, 1460, 1461, 1462, 1463, 1464, 1465, 1466, 1467, 1468, 1469, 1470, 1471, 1472, 1473, 1474, 1475, 1476, 1477, 1478, 1479, 1480, 1481, 1482, 1483, 1484, 1485, 1486, 1487, 1488, 1489, 1490, 1491, 1492, 1493, 1494, 1495, 1496, 1497, 1498, 1499, 1500, 1501, 1502, 1503, 1504, 1505, 1506, 1507, 1508, 1509, 1510, 1511, 1512, 1513, 1514, 1515, 1516, 1517, 1518, 1519, 1520, 1521, 1522, 1523, 1524, 1525, 1526, 1527, 1528, 1529, 1530, 1531, 1532, 1533, 1534, 1535, 1536, 1537, 1538, 1539, 1540, 1541, 1542, 1543, 1544, 1545, 1546, 1547, 1548, 1549, 1550, 1551, 1552, 1553, 1554, 1555, 1556, 1557, 1558, 1559, 1560, 1561, 1562, 1563, 1564, 1565, 1566, 1567, 1568, 1569, 1570, 1571, 1572, 1573, 1574, 1575, 1576, 1577, 1578, 1579, 1580, 1581, 1582, 1583, 1584, 1585, 1586, 1587, 1588, 1589, 1590, 1591, 1592, 1593, 1594, 1595, 1596, 1597, 1598, 1599, 1600, 1601, 1602, 1603, 1604, 1605, 1606, 1607, 1608, 1609, 1610, 1611, 1612, 1613, 1614, 1615, 1616, 1617, 1618, 1619, 1620, 1621, 1622, 1623, 1624, 1625, 1626, 1627, 1628, 1629, 1630, 1631, 1632, 1633, 1634, 1635, 1636, 1637, 1638, 1639, 1640, 1641, 1642, 1643, 1644, 1645, 1646, 1647, 1648, 1649, 1650, 1651, 1652, 1653, 1654, 1655, 1656, 1657, 1658, 1659, 1660, 1661, 1662, 1663, 1664, 1665, 1666, 1667, 1668, 1669, 1670, 1671, 1672, 1673, 1674, 1675, 1676, 1677, 1678, 1679, 1680, 1681, 1682, 1683, 1684, 1685, 1686, 1687, 1688, 1689, 1690, 1691, 1692, 1693, 1694, 1695, 1696, 1697, 1698, 1699, 1700, 1701, 1702, 1703, 1704, 1705, 1706, 1707, 1708, 1709, 1710, 1711, 1712, 1713, 1714, 1715, 1716, 1717, 1718, 1719, 1720, 1721, 1722, 1723, 1724, 1725, 1726, 1727, 1728, 1729, 1730, 1731, 1732, 1733, 1734, 1735, 1736, 1737, 1738, 1739, 1740, 1741, 1742, 1743, 1744, 1745, 1746, 1747, 1748, 1749, 1750, 1751, 1752, 1753, 1754, 1755, 1756, 1757, 1758, 1759, 1760, 1761, 1762, 1763, 1764, 1765, 1766, 1767, 1768, 1769, 1770, 1771, 1772, 1773, 1774, 1775, 1776, 1777, 1778, 1779, 1780, 1781, 1782, 1783, 1784, 1785, 1786, 1787, 1788, 1789, 1790, 1791, 1792, 1793, 1794, 1795, 1796, 1797, 1798, 1799, 1800, 1801, 1802, 1803, 1804, 1805, 1806, 1807, 1808, 1809, 1810, 1811, 1812, 1813, 1814, 1815, 1816, 1817, 1818, 1819, 1820, 1821, 1822, 1823, 1824, 1825, 1826, 1827, 1828, 1829, 1830, 1831, 1832, 1833, 1834, 1835, 1836, 1837, 1838, 1839, 1840, 1841, 1842, 1843, 1844, 1845, 1846, 1847, 1848, 1849, 1850, 1851, 1852, 1853, 1854, 1855, 1856, 1857, 1858, 1859, 1860, 1861, 1862, 1863, 1864, 1865, 1866, 1867, 1868, and 1869, this can be used to diagnose or prognose fast-progressing liver fibrosis in a subject. In some examples, downregulation is a decrease of at least 0.5 fold, at least 0.8 fold, at least 1-fold, at least 2-fold, at least 2.5-fold, at least 3-fold, at least 3.5-fold, at least 4-fold or at least 4.5-fold. In addition, if two or more of SEQ ID NOS: 1870-2633 are upregualted relative to a control (such as an amount of protein expression expected in a subject or population of subjects having non-progressing liver fibrosis), such as two or more of any of SEQ ID NOS: 1870, 1871, 1872, 1873, 1874, 1875, 1876, 1877, 1878, 1879, 1880, 1881, 1882, 1883, 1884, 1885, 1886, 1887, 1888, 1889, 1890, 1891, 1892, 1893, 1894, 1895, 1896, 1897, 1898, 1899, 1900, 1901, 1902, 1903, 1904, 1905, 1906, 1907, 1908, 1909, 1910, 1911, 1912, 1913, 1914, 1915, 1916, 1917, 1918, 1919, 1920, 1921, 1922, 1923, 1924, 1925, 1926, 1927, 1928, 1929, 1930, 1931, 1932, 1933, 1934, 1935, 1936, 1937, 1938, 1939, 1940, 1941, 1942, 1943, 1944, 1945, 1946, 1947, 1948, 1949, 1950, 1951, 1952, 1953, 1954, 1955, 1956, 1957, 1958, 1959, 1960, 1961, 1962, 1963, 1964, 1965, 1966, 1967, 1968, 1969, 1970, 1971, 1972, 1973, 1974, 1975, 1976, 1977, 1978, 1979, 1980, 1981, 1982, 1983, 1984, 1985, 1986, 1987, 1988, 1989, 1990, 1991, 1992, 1993, 1994, 1995, 1996, 1997, 1998, 1999, 2000, 2001, 2002, 2003, 2004, 2005, 2006, 2007, 2008, 2009, 2010, 2011, 2012, 2013, 2014, 2015, 2016, 2017, 2018, 2019, 2020, 2021, 2022, 2023, 2024, 2025, 2026, 2027, 2028, 2029, 2030, 2031, 2032, 2033, 2034, 2035, 2036, 2037, 2038, 2039, 2040, 2041, 2042, 2043, 2044, 2045, 2046, 2047, 2048, 2049, 2050, 2051, 2052, 2053, 2054, 2055, 2056, 2057, 2058, 2059, 2060, 2061, 2062, 2063, 2064, 2065, 2066, 2067, 2068, 2069, 2070, 2071, 2072, 2073, 2074, 2075, 2076, 2077, 2078, 2079, 2080, 2081, 2082, 2083, 2084, 2085, 2086, 2087, 2088, 2089, 2090, 2091, 2092, 2093, 2094, 2095, 2096, 2097, 2098, 2099, 2100, 2101, 2102, 2103, 2104, 2105, 2106, 2107, 2108, 2109, 2110, 2111, 2112, 2113, 2114, 2115, 2116, 2117, 2118, 2119, 2120, 2121, 2122, 2123, 2124, 2125, 2126, 2127, 2128, 2129, 2130, 2131, 2132, 2133, 2134, 2135, 2136, 2137, 2138, 2139, 2140, 2141, 2142, 2143, 2144, 2145, 2146, 2147, 2148, 2149, 2150, 2151, 2152, 2153, 2154, 2155, 2156, 2157, 2158, 2159, 2160, 2161, 2162, 2163, 2164, 2165, 2166, 2167, 2168, 2169, 2170, 2171, 2172, 2173, 2174, 2175, 2176, 2177, 2178, 2179, 2180, 2181, 2182, 2183, 2184, 2185, 2186, 2187, 2188, 2189, 2190, 2191, 2192, 2193, 2194, 2195, 2196, 2197, 2198, 2199, 2200, 2201, 2202, 2203, 2204, 2205, 2206, 2207, 2208, 2209, 2210, 2211, 2212, 2213, 2214, 2215, 2216, 2217, 2218, 2219, 2220, 2221, 2222, 2223, 2224, 2225, 2226, 2227, 2228, 2229, 2230, 2231, 2232, 2233, 2234, 2235, 2236, 2237, 2238, 2239, 2240, 2241, 2242, 2243, 2244, 2245, 2246, 2247, 2248, 2249, 2250, 2251, 2252, 2253, 2254, 2255, 2256, 2257, 2258, 2259, 2260, 2261, 2262, 2263, 2264, 2265, 2266, 2267, 2268, 2269, 2270, 2271, 2272, 2273, 2274, 2275, 2276, 2277, 2278, 2279, 2280, 2281, 2282, 2283, 2284, 2285, 2286, 2287, 2288, 2289, 2290, 2291, 2292, 2293, 2294, 2295, 2296, 2297, 2298, 2299, 2300, 2301, 2302, 2303, 2304, 2305, 2306, 2307, 2308, 2309, 2310, 2311, 2312, 2313, 2314, 2315, 2316, 2317, 2318, 2319, 2320, 2321, 2322, 2323, 2324, 2325, 2326, 2327, 2328, 2329, 2330, 2331, 2332, 2333, 2334, 2335, 2336, 2337, 2338, 2339, 2340, 2341, 2342, 2343, 2344, 2345, 2346, 2347, 2348, 2349, 2350, 2351, 2352, 2353, 2354, 2355, 2356, 2357, 2358, 2359, 2360, 2361, 2362, 2363, 2364, 2365, 2366, 2367, 2368, 2369, 2370, 2371, 2372, 2373, 2374, 2375, 2376, 2377, 2378, 2379, 2380, 2381, 2382, 2383, 2384, 2385, 2386, 2387, 2388, 2389, 2390, 2391, 2392, 2393, 2394, 2395, 2396, 2397, 2398, 2399, 2400, 2401, 2402, 2403, 2404, 2405, 2406, 2407, 2408, 2409, 2410, 2411, 2412, 2413, 2414, 2415, 2416, 2417, 2418, 2419, 2420, 2421, 2422, 2423, 2424, 2425, 2426, 2427, 2428, 2429, 2430, 2431, 2432, 2433, 2434, 2435, 2436, 2437, 2438, 2439, 2440, 2441, 2442, 2443, 2444, 2445, 2446, 2447, 2448, 2449, 2450, 2451, 2452, 2453, 2454, 2455, 2456, 2457, 2458, 2459, 2460, 2461, 2462, 2463, 2464, 2465, 2466, 2467, 2468, 2469, 2470, 2471, 2472, 2473, 2474, 2475, 2476, 2477, 2478, 2479, 2480, 2481, 2482, 2483, 2484, 2485, 2486, 2487, 2488, 2489, 2490, 2491, 2492, 2493, 2494, 2495, 2496, 2497, 2498, 2499, 2500, 2501, 2502, 2503, 2504, 2505, 2506, 2507, 2508, 2509, 2510, 2511, 2512, 2513, 2514, 2515, 2516, 2517, 2518, 2519, 2520, 2521, 2522, 2523, 2524, 2525, 2526, 2527, 2528, 2529, 2530, 2531, 2532, 2533, 2534, 2535, 2536, 2537, 2538, 2539, 2540, 2541, 2542, 2543, 2544, 2545, 2546, 2547, 2548, 2549, 2550, 2551, 2552, 2553, 2554, 2555, 2556, 2557, 2558, 2559, 2560, 2561, 2562, 2563, 2564, 2565, 2566, 2567, 2568, 2569, 2570, 2571, 2572, 2573, 2574, 2575, 2576, 2577, 2578, 2579, 2580, 2581, 2582, 2583, 2584, 2585, 2586, 2587, 2588, 2589, 2590, 2591, 2592, 2593, 2594, 2595, 2596, 2597, 2598, 2599, 2600, 2601, 2602, 2603, 2604, 2605, 2606, 2607, 2608, 2609, 2610, 2611, 2612, 2613, 2614, 2615, 2616, 2617, 2618, 2619, 2620, 2621, 2622, 2623, 2624, 2625, 2626, 2627, 2628, 2629, 2630, 2631, 2632, and 2633, this can be used to diagnose or prognose fast-progressing liver fibrosis in a subject. In some examples, the upregulation is an increase of at least 0.5 fold, at least 1-fold, at least 1.5-fold, at least 2-fold, at least 2.5-fold, at least 3-fold, or at least 3.3-fold.

In a specific example, expression of two or more of the liver fibrosis-related proteins (or corresponding peptides or nucleic acid molecules) labeled under "Proteins showing significant differential expression only in Fast-Progressing Liver Fibrosis" in Table 2 can be used to diagnose or prognose fast-progressing liver fibrosis in a subject, such as by detecting expression of at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 31, at least 31, at least 32, at least 33, at least 34, or all 35 such proteins (or corresponding peptides or nucleic acid molecules) in Table 2. For example, if at least two of the liver fibrosis-related molecules in Table 2 (such as at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 31, at least 31, at least 32, at least 33, at least 34, or all 35 labeled under "Proteins showing significant differential expression only in Fast-Progressing Liver Fibrosis") show the relative amount and direction of differential expression in the test sample, relative to a control (such as an amount of protein expression expected in a subject or population of subjects having non-progressing liver fibrosis), this results in a diagnosis of fast-progressing liver fibrosis, or a prognosis that the subject will develop a fast-progressing liver fibrosis in the future.

In another example, expression of two or more (e.g., at least 3, at least 4) of the liver fibrosis-related proteins (or corresponding peptides or nucleic acid molecules) labeled under "Proteins showing significant differential expression in opposite directions for Fast and Slow-Progressing Liver Fibrosis" in Table 2 can be used to diagnose or prognose fast-progressing liver fibrosis in a subject, such as by detecting expression of at least 3, at least 4, at least 5 or all 6 such proteins (or corresponding peptides or nucleic acid molecules) labeled under "Proteins showing significant differential expression in opposite directions for Fast and Slow-Progressing Liver Fibrosis" in Table 2. For example, if at least two (e.g., at least 3, at least 4) of the liver fibrosis-related molecules in Table 2, such as at least 5 or all 6 of the proteins labeled under "Proteins showing significant differential expression in opposite directions for Fast and Slow-Progressing Liver Fibrosis" show the relative amount and direction of differential expression (i.e., up-regulation) in the test sample, relative to a control (such as an amount of protein expression expected in a subject or population of subjects having non-progressing liver fibrosis), this results in a diagnosis of fast-progressing liver fibrosis, or a prognosis that the subject will develop a fast-progressing liver fibrosis in the future.

TABLE 2

112 Liver Fibrosis Related Proteins with Differential Expression in Post-Transplant Fast-Progressing Liver Fibrosis relative to matched controls representing protein expression in a subject with non-progressing liver fibrosis

| Gene | Protein and UniProt Accession Number | Up-regulated | Down-regulated | Fold-Change vs. Control |
| --- | --- | --- | --- | --- |
| PTPRG | P23470 Receptor-type tyrosine-protein phosphatase gamma | X | | At least 1.2-fold |
| QSOX1 | O00391 Sulfhydryl oxidase 1 | X | | At least 1.7-fold |
| GPX3 | P22352 Glutathione peroxidase 3 | X | | At least 1.3-fold |
| . | P04433 Ig kappa chain V-III region VG | X | | At least 3.1-fold |
| . | P18135 Ig kappa chain V-III region HAH | X | | At least 2.3-fold |
| . | P80748 Ig lambda chain V-III region LOI | X | | At least 2.1-fold |
| IGHA1 | P01876 Ig alpha-1 chain C region | X | | At least 2.8-fold |
| IGHG1 | P01857 Ig gamma-1 chain C region | X | | At least 2.2-fold |
| IGHG2 | P01859 Ig gamma-2 chain C region | X | | At least 2.4-fold |
| IGHM | P01871 Ig mu chain C region | X | | At least 1.6-fold |
| IGKC | P01834 Ig kappa chain C region | X | | At least 1.8-fold |
| IGKV1-5 | P01602 Ig kappa chain V-I region HK102 | X | | At least 2-fold |
| IGLC1 | P01842 Ig lambda chain C regions | X | | At least 1.8-fold |
| FCGR3A | P08637 Low affinity immunoglobulin gamma Fc region receptor III-A | X | | At least 1.8-fold |
| A2M | P01023 Alpha-2-macroglobulin | X | | At least 1.5-fold |
| ACTB | Q96HG5 Actin, cytoplasmic 1 | X | | At least 1.2-fold |
| AFM | P43652 Afamin | X | | At least 1.3-fold |
| AHSG | P02765 Alpha-2-HS-glycoprotein | X | | At least 1.5-fold |
| ALCAM | Q13740 CD166 antigen | X | | At least 1.5-fold |
| APOB | Q13787 Apolipoprotein B-100 | X | | At least 1.2-fold |
| APOE | P02649 Apolipoprotein E | X | | At least 1.3-fold |
| C7 | P10643 Complement component C7 | X | | At least 2.1-fold |
| CLU | P10909 Clusterin | X | | At least 1.2-fold |
| ECM1 | Q8IZ60 Extracellular matrix protein 1 | X | | At least 1.3-fold |
| HBB | Q549N7 Hemoglobin subunit beta | X | | At least 1.5-fold |

TABLE 2-continued

112 Liver Fibrosis Related Proteins with Differential Expression in
Post-Transplant Fast-Progressing Liver Fibrosis relative to matched
controls representing protein expression in a subject with non-progressing
liver fibrosis

| Gene | Protein and UniProt Accession Number | Up-regulated | Down-regulated | Fold-Change vs. Control |
|---|---|---|---|---|
| ITIH3 | Q06033 Inter-alpha-trypsin inhibitor heavy chain H3 | X | | At least 1.2-fold |
| LGALS3BP | Q08380 Galectin-3-binding protein | X | | At least 2.2-fold |
| MBL2 | P11226 Mannose-binding protein C | X | | At least 1.6-fold |
| SELL | P14151 L-selectin | X | | At least 1.3-fold |
| SERPINA1 | Q86U18 Alpha-1-antitrypsin | X | | At least 3-fold |
| SERPINA6 | P08185 Corticosteroid-binding globulin | X | | At least 1.2-fold |
| SHBG | P04278 Sex hormone-binding globulin | X | | At least 1.6-fold |
| VCAM1 | P19320 Vascular cell adhesion protein 1 | X | | At least 1.4-fold |
| VWF | P04275 von Willebrand factor | X | | At least 1.3-fold |
| F2 | P00734 Prothrombin | | X | At least 1.3-fold |
| CFB | Q9BX92 Complement factor B | | X | At least 1.2-fold |
| CFI | P05156 Complement factor I | | X | At least 1.1-fold |
| C1S | Q9UCV4 Complement C1s subcomponent | | X | At least 1.2-fold |
| C1R | P00736 Complement C1r subcomponent | | X | At least 1.2-fold |
| KLKB1 | P03952 Plasma kallikrein | | X | At least 1.3-fold |
| F11 | P03951 Coagulation factor XI | | X | At least 1.3-fold |
| F9 | P00740 Coagulation factor IX | | X | At least 1.2-fold |
| CNDP1 | Q96KN2 Beta-Ala-His dipeptidase | | X | At least 1.8-fold |
| BCHE | P06276 Cholinesterase | | X | At least 1.3-fold |
| ALB | Q9P157 Serum albumin | | X | At least 2.8-fold |
| APCS | P02743 Serum amyloid P-component | | X | At least 1.3-fold |
| APOA4 | P06727 Apolipoprotein A-IV | | X | At least 1.2-fold |
| APOC3 | P02656 Apolipoprotein C-III | | X | At least 2.4-fold |
| APOH | P02749 Beta-2-glycoprotein 1 | | X | At least 1.3-fold |
| AZGP1 | P25311 Zinc-alpha-2-glycoprotein | | X | At least 1.2-fold |
| C4A | Q5JQM8 Complement C4-A | | X | At least 1.5-fold |
| C6 | P13671 Complement component C6 | | X | At least 1.3-fold |
| C8A | P07357 Complement component C8 alpha chain | | X | At least 1.4-fold |
| C8B | P07358 Complement component C8 beta chain | | X | At least 1.3-fold |
| C8G | P07360 Complement component C8 gamma chain | | X | At least 1.2-fold |
| C9 | P02748 Complement component C9 | | X | At least 1.2-fold |
| FGA | P02671 Fibrinogen alpha chain | | X | At least 1.8-fold |
| HPX | P02790 Hemopexin | | X | At least 1.2-fold |
| HRG | P04196 Histidine-rich glycoprotein | | X | At least 1.3-fold |
| IGFALS | P35858 Insulin-like growth factor-binding protein complex acid labile subunit | | X | At least 1.3-fold |
| ITIH1 | P19827 Inter-alpha-trypsin inhibitor heavy chain H1 | | X | At least 1.3-fold |

TABLE 2-continued

112 Liver Fibrosis Related Proteins with Differential Expression in Post-Transplant Fast-Progressing Liver Fibrosis relative to matched controls representing protein expression in a subject with non-progressing liver fibrosis

| Gene | Protein and UniProt Accession Number | Up-regulated | Down-regulated | Fold-Change vs. Control |
|---|---|---|---|---|
| ITIH2 | P19823 Inter-alpha-trypsin inhibitor heavy chain H2 | | X | At least 1.1-fold |
| ITIH4 | Q14624 Inter-alpha-trypsin inhibitor heavy chain H4 | | X | At least 1.1-fold |
| ORM1 | P02763 Alpha-1-acid glycoprotein 1 | | X | At least 1.8-fold |
| ORM2 | P19652 Alpha-1-acid glycoprotein 2 | | X | At least 1.5-fold |
| PRG4 | Q92954 Proteoglycan 4 | | X | At least 1.2-fold |
| RBP4 | P02753 Retinol-binding protein 4 | | X | At least 1.1-fold |
| SERPINA3 | Q6NSC9 Alpha-1-antichymotrypsin | | X | At least 1.2-fold |
| SERPINC1 | Q9UC78 Antithrombin-III | | X | At least 1.2-fold |
| SERPIND1 | P05546 Heparin cofactor 2 | | X | At least 1.2-fold |
| TTR | P02766 Transthyretin | | X | At least 1.3-fold |
| *Proteins showing significant differential expression in opposite directions for Fast and Slow-Progressing Liver Fibrosis* | | | | |
| F10 | P00742 Coagulation factor X | X | | At least 1.2 fold |
| FN1 | Q9HAP3 Fibronectin | X | | At least 1.5-fold |
| C5 | P01031 Complement C5 | X | | At least 1.2-fold |
| SERPINA4 | P29622 Kallistatin | X | | At least 1.3-fold |
| VTN | P04004 Vitronectin | X | | At least 1.2-fold |
| LUM | P51884 Lumican | X | | At least 1.1-fold |
| *Proteins showing significant differential expression only in Fast-Progressing Liver Fibrosis* | | | | |
| PTGDS | P41222 Prostaglandin-H2 D-isomerase | X | | At least 1.2-fold |
| CA1 | P00915 Carbonic anhydrase 1 | X | | At least 2.1-fold |
| ALDOB | P05062 Fructose-bisphosphate aldolase B | X | | At least 1.7-fold |
| C2 | P06681 Complement C2 | X | | At least 1.2-fold |
| F12 | P00748 Coagulation factor XII | X | | At least 1.2-fold |
| MASP2 | Q9H498 Mannan-binding lectin serine protease 2 | X | | At least 1.2-fold |
| HABP2 | Q14520 Hyaluronan-binding protein 2 | X | | At least 1.4-fold |
| ANPEP | P15144 Aminopeptidase N | X | | At least 1.4-fold |
| ENPP2 | Q9UCR2 Ectonucleotide pyrophosphatase/phosphodiesterase family member 2 | X | | At least 1.5-fold |
| CP | P00450 Ceruloplasmin | X | | At least 1.1-fold |
| PRDX2 | P32119 Peroxiredoxin-2 | X | | At least 1.6-fold |
| A1BG | P04217 Alpha-1B-glycoprotein* | X | | At least 1.1-fold |
| TGFBI | Q53XM1 Transforming growth factor-beta-induced protein ig-h3 | X | | At least 1.4-fold |
| CD14 | P08571 Monocyte differentiation antigen CD14 | X | | At least 1.3-fold |
| C3 | P01024 Complement C3 | X | | At least 1.3-fold |
| ENG | P17813 Endoglin | X | | At least 1.3-fold |

TABLE 2-continued

112 Liver Fibrosis Related Proteins with Differential Expression in Post-Transplant Fast-Progressing Liver Fibrosis relative to matched controls representing protein expression in a subject with non-progressing liver fibrosis

| Gene | Protein and UniProt Accession Number | Up-regulated | Down-regulated | Fold-Change vs. Control |
|---|---|---|---|---|
| PROCR | Q9UNN8 Endothelial protein C receptor | X | | At least 1.2-fold |
| FCGBP | Q9Y6R7 IgGFc-binding protein | X | | At least 1.4-fold |
| FCN3 | O75636 Ficolin-3 | X | | At least 1.3-fold |
| FETUB | Q9UGM5 Fetuin-B | X | | At least 1.3-fold |
| MST1 | P26927 Hepatocyte growth factor-like protein | X | | At least 1.4-fold |
| MCAM | P43121 Cell surface glycoprotein MUC18 | X | | At least 1.2-fold |
| NRP1 | O14786 Neuropilin-1 | X | | At least 1.3-fold |
| SPP2 | Q13103 Secreted phosphoprotein 24 | X | | At least 1.4-fold |
| SERPINA7 | P05543 Thyroxine-binding globulin | X | | At least 1.5-fold |
| VASN | Q6EMK4 Vasorin | X | | At least 1.2-fold |
| COL18A1 | Q96T70 Collagen alpha-1(XVIII) chain | X | | At least 1.8-fold |
| PVR | P15151 Poliovirus receptor | X | | At least 1.6-fold |
| APOA2 | P02652 Apolipoprotein A-II | X | | At least 1.8-fold |
| PI16 | Q6UXB8 Peptidase inhibitor 16 | X | | At least 1.9-fold |
| H6PD | O95479 GDH/6PGL endoplasmic bifunctional protein | | X | At least 1.5-fold |
| AGT | P01019 Angiotensinogen | | X | At least 1.3-fold |
| CFH | Q9NU86 Complement factor H | | X | At least 1.2-fold |
| CRP | P02741 C-reactive protein | | X | At least 1.6-fold |
| GSN | P06396 Gelsolin | | X | At least 1.3-fold |

Table 3 provides directionality and relative amounts of differential expression detected for liver fibrosis-related proteins in subjects having post-transplant liver fibrosis which showed differential expression in slow-progressing liver fibrosis relative to matched controls representing the amount of protein expression in a subject with non-progressing liver fibrosis. Differential expression for the proteins ranged from 1.1-fold to more than 3-fold. Thus, expression of two or more of the liver fibrosis-related proteins (or corresponding peptides or nucleic acid molecules) in Table 3 can be used to diagnose or prognose slow-progressing liver fibrosis in a subject, such as by detecting expression of at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 31, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, at least 60, at least 61, at least 62, at least 63, at least 64, at least 65, at least 66, at least 67, at least 68, at least 69, at least 70, at least 71, at least 72, at least 73, at least 74, at least 75, at least 76, at least 77, at least 78, at least 79, at least 80, at least 81, at least 82, at least 83, at least 84, at least 85, at least 86, at least 87, at least 88, at least 89, at least 90, at least 91, at least 92, at least 93, at least 94, at least 95, at least 96, at least 97, at least 98, at least 99, at least 100, or all 101 of the proteins (or corresponding peptides or nucleic acid molecules) in Table 3. For example, if at least two of the liver fibrosis-related molecules in Table 3 (such as at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 31, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, at least 60, at least 61, at least 62, at least 63, at least 64, at least 65, at least 66, at least 67, at least 68, at least 69, at least 70, at least 71, at least 72, at least 73, at least 74, at least 75, at least 76, at least 77, at least 78, at least 79, at least 80, at least 81, at least 82, at least 83, at least 84, at least 85, at least 86, at least 87, at least 88, at least 89, at least 90, at least 91, at least 92, at least 93, at least 94, at least 95, at least 96, at least 97, at least 98, at least 99, at least 100, or all 101 of the proteins) show the relative amount and direction of differential expression in the test sample, relative to a control (such as an amount of protein expression expected in a subject or population of subjects having non-progressing liver fibrosis), this results in a diagnosis of slow-progressing liver fibrosis, or a prognosis that the subject will develop a slow-progressing liver fibrosis in the future.

In a specific example, expression of two or more of the liver fibrosis-related proteins (or corresponding peptides or nucleic acid molecules) labeled under "Proteins showing significant differential expression only in Slow-Progressing Liver Fibrosis" in Table 3 can be used to diagnose or prognose slow-progressing liver fibrosis in a subject, such as by detecting expression of at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, or all 24 such proteins (or corresponding peptides or nucleic acid molecules) in Table 3. For example, if at least two of the liver fibrosis-related molecules in Table 3 (such as at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, or all 24, such as 3, 4, 5, 6, 7, 8, 9, 10, 11, 12, 13, 14, 15, 16, 17, 18, 19, 20, 21, 22, 23, or 24, labeled under "Proteins showing significant differential expression only in Slow-Progressing Liver Fibrosis") show the relative amount and direction of differential expression in the test sample, relative to a control (such as an amount of protein expression expected in a subject or population of subjects having non-progressing liver fibrosis), this results in a diagnosis of slow-progressing liver fibrosis, or a prognosis that the subject will develop a slow-progressing liver fibrosis in the future.

In another example, expression of two or more of the liver fibrosis-related proteins (or corresponding peptides or nucleic acid molecules) labeled under "Proteins showing significant differential expression in opposite directions for Fast and Slow-Progressing Liver Fibrosis" in Table 3 can be used to diagnose or prognose slow-progressing liver fibrosis in a subject, such as by detecting expression of at least 3, at least 4, at least 5 or all 6 such proteins, such as 3, 4, 5, or 6 of the proteins (or corresponding peptides or nucleic acid molecules) labeled under "Proteins showing significant differential expression in opposite directions for Fast and Slow-Progressing Liver Fibrosis" in Table 3. For example, if at least two of the liver fibrosis-related molecules in Table 3, such as at least 3, at least 4, at least 5 or all 6 of the proteins labeled under "Proteins showing significant differential expression in opposite directions for Fast and Slow-Progressing Liver Fibrosis" show the relative amount and direction of differential expression (i.e., down-regulation) in the test sample, relative to a control (such as an amount of protein expression expected in a subject or population of subjects having non-progressing liver fibrosis), this results in a diagnosis of slow-progressing liver fibrosis, or a prognosis that the subject will develop a slow-progressing liver fibrosis in the future.

The fold-change relative to controls observed for the proteins demonstrating differential expression in slow-progressing liver fibrosis is provided in Table 3. A large group of the proteins (38) showed more than a 1.5-fold change in slow-progressing liver fibrosis, and 21 of these proteins showed more than a 2-fold change. Thus in some examples, these 38 proteins or 21 proteins are used in the methods and systems provided herein to diagnose or prognose slow-progressing liver fibrosis. 30 of the proteins listed with differential expression in slow-progressing liver fibrosis either did not show differential expression in fast-progressing liver fibrosis or exhibited differential expression in the opposite direction. Of these 30 proteins, 7 had more than a 1.5-fold change in slow-progressing liver fibrosis. Thus in some examples, these 7 proteins are used in the methods and systems provided herein to diagnose or prognose slow-progressing liver fibrosis.

Similarly, expression of two or more of the liver fibrosis-related peptides in any of SEQ ID NOS: 1-1280 can be used to diagnose or prognose slow-progressing liver fibrosis in a subject. Thus, expression of 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 701, 702, 703, 704, 705, 706, 707, 708, 709, 710, 711, 712, 713, 714, 715, 716, 717, 718, 719, 720, 721, 722, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 847, 848, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 903, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, 950, 951, 952, 953, 954, 955, 956, 957, 958, 959, 960, 961, 962, 963, 964, 965, 966, 967, 968, 969, 970, 971, 972, 973, 974, 975, 976, 977, 978, 979, 980, 981, 982, 983, 984, 985, 986, 987, 988, 989, 990, 991, 992, 993, 994, 995, 996, 997, 998, 999, 1000, 1001, 1002, 1003, 1004, 1005, 1006, 1007, 1008, 1009, 1010, 1011, 1012, 1013, 1014, 1015, 1016, 1017, 1018, 1019, 1020, 1021, 1022, 1023, 1024, 1025, 1026, 1027, 1028, 1029, 1030, 1031, 1032, 1033, 1034, 1035, 1036, 1037, 1038, 1039, 1040, 1041, 1042, 1043, 1044, 1045, 1046, 1047, 1048, 1049, 1050, 1051, 1052, 1053, 1054, 1055, 1056, 1057, 1058, 1059, 1060, 1061, 1062, 1063, 1064, 1065, 1066, 1067, 1068, 1069, 1070, 1071, 1072, 1073, 1074, 1075, 1076, 1077, 1078, 1079, 1080, 1081, 1082, 1083, 1084, 1085, 1086, 1087, 1088, 1089, 1090, 1091, 1092, 1093, 1094, 1095, 1096, 1097, 1098, 1099, 1100, 1101, 1102, 1103, 1104, 1105, 1106, 1107, 1108, 1109, 1110, 1111, 1112, 1113, 1114, 1115, 1116, 1117, 1118, 1119, 1120, 1121, 1122, 1123, 1124, 1125, 1126, 1127, 1128, 1129, 1130, 1131, 1132, 1133, 1134, 1135, 1136, 1137, 1138, 1139, 1140, 1141, 1142, 1143, 1144, 1145, 1146, 1147, 1148, 1149, 1150, 1151, 1152, 1153, 1154, 1155, 1156, 1157, 1158, 1159, 1160, 1161, 1162, 1163, 1164, 1165, 1166, 1167, 1168, 1169, 1170, 1171, 1172, 1173, 1174, 1175, 1176, 1177, 1178, 1179, 1180, 1181, 1182, 1183, 1184, 1185, 1186, 1187, 1188, 1189, 1190, 1191, 1192, 1193, 1194, 1195, 1196, 1197, 1198, 1199, 1200, 1201, 1202, 1203, 1204, 1205, 1206, 1207, 1208, 1209, 1210, 1211, 1212, 1213, 1214, 1215, 1216, 1217, 1218, 1219, 1220, 1221, 1222, 1223, 1224, 1225, 1226, 1227, 1228, 1229, 1230, 1231, 1232, 1233, 1234, 1235, 1236, 1237, 1238, 1239, 1240, 1241, 1242, 1243, 1244, 1245, 1246, 1247, 1248, 1249, 1250, 1251, 1252, 1253, 1254, 1255, 1256, 1257, 1258, 1259, 1260, 1261, 1262, 1263, 1264, 1265, 1266, 1267, 1268, 1269, 1270, 1271, 1272, 1273, 1274, 1275, 1276, 1277, 1278, 1279, or 1280 of the liver fibrosis-related peptides in any of SEQ ID NOS: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 701, 702, 703, 704, 705, 706, 707, 708, 709, 710, 711, 712, 713, 714, 715, 716, 717, 718, 719, 720, 721, 722, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 847, 848, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 903, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, 950, 951, 952, 953, 954, 955, 956, 957, 958, 959, 960, 961, 962, 963, 964, 965, 966, 967, 968, 969, 970, 971, 972, 973, 974, 975, 976, 977, 978, 979, 980, 981, 982, 983, 984, 985, 986, 987, 988, 989, 990, 991, 992, 993, 994, 995, 996, 997, 998, 999, 1000, 1001, 1002, 1003, 1004, 1005, 1006, 1007, 1008, 1009, 1010, 1011, 1012, 1013, 1014, 1015, 1016, 1017, 1018, 1019, 1020, 1021, 1022, 1023, 1024, 1025, 1026, 1027, 1028, 1029, 1030, 1031, 1032, 1033, 1034, 1035, 1036, 1037, 1038, 1039, 1040, 1041, 1042, 1043, 1044, 1045, 1046, 1047, 1048, 1049, 1050, 1051, 1052, 1053, 1054, 1055, 1056, 1057, 1058, 1059, 1060, 1061, 1062, 1063, 1064, 1065, 1066, 1067, 1068, 1069, 1070, 1071, 1072, 1073, 1074, 1075, 1076, 1077, 1078, 1079, 1080, 1081, 1082, 1083, 1084, 1085, 1086, 1087, 1088, 1089, 1090, 1091, 1092, 1093, 1094, 1095, 1096, 1097, 1098, 1099, 1100, 1101, 1102, 1103, 1104, 1105, 1106, 1107, 1108, 1109, 1110, 1111, 1112, 1113, 1114, 1115, 1116, 1117, 1118, 1119, 1120, 1121, 1122, 1123, 1124, 1125, 1126, 1127, 1128, 1129, 1130, 1131, 1132, 1133, 1134, 1135, 1136, 1137, 1138, 1139, 1140, 1141, 1142, 1143, 1144, 1145, 1146, 1147, 1148, 1149, 1150, 1151, 1152, 1153, 1154, 1155, 1156, 1157, 1158, 1159, 1160, 1161, 1162, 1163, 1164, 1165, 1166, 1167, 1168, 1169, 1170, 1171, 1172, 1173, 1174, 1175, 1176, 1177, 1178, 1179, 1180, 1181, 1182, 1183, 1184, 1185, 1186, 1187, 1188, 1189, 1190, 1191, 1192, 1193, 1194, 1195, 1196, 1197, 1198, 1199, 1200, 1201, 1202, 1203, 1204, 1205, 1206, 1207, 1208, 1209, 1210, 1211, 1212, 1213, 1214, 1215, 1216, 1217, 1218, 1219, 1220, 1221, 1222, 1223, 1224, 1225, 1226, 1227, 1228, 1229, 1230, 1231, 1232, 1233, 1234, 1235, 1236, 1237, 1238, 1239, 1240, 1241, 1242, 1243, 1244, 1245, 1246, 1247, 1248, 1249, 1250, 1251, 1252, 1253, 1254, 1255, 1256, 1257, 1258, 1259, 1260, 1261, 1262, 1263, 1264, 1265, 1266, 1267, 1268, 1269, 1270, 1271, 1272, 1273, 1274, 1275, 1276, 1277, 1278, 1279, and 1280, can be used to diagnose or prognose slow-progressing liver fibrosis in a subject. For example, if two or more of SEQ ID NOS: 768-1280 are upregualted relative to a control (such as an amount of protein expression expected in a subject or population of subjects having non-progressing liver fibrosis), such as two or more of any of SEQ ID NOS: 768, 769, 770, 771, 772, 773, 774, 775, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 847, 848, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 903, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, 950, 951, 952, 953, 954, 955, 956, 957, 958, 959, 960, 961, 962, 963, 964, 965, 966, 967, 968, 969, 970, 971, 972, 973, 974, 975, 976, 977, 978, 979, 980, 981, 982, 983, 984, 985, 986, 987, 988, 989, 990, 991, 992, 993, 994, 995, 996, 997, 998, 999, 1000, 1001, 1002, 1003, 1004, 1005, 1006, 1007, 1008, 1009, 1010, 1011, 1012, 1013, 1014, 1015, 1016, 1017, 1018, 1019, 1020, 1021, 1022, 1023, 1024, 1025, 1026, 1027, 1028, 1029, 1030, 1031, 1032, 1033, 1034, 1035, 1036, 1037, 1038, 1039, 1040, 1041, 1042, 1043, 1044, 1045, 1046, 1047, 1048, 1049, 1050, 1051, 1052, 1053, 1054, 1055, 1056, 1057, 1058, 1059, 1060, 1061, 1062, 1063, 1064, 1065, 1066, 1067, 1068, 1069, 1070, 1071, 1072, 1073, 1074, 1075, 1076, 1077, 1078, 1079, 1080, 1081, 1082, 1083, 1084, 1085, 1086, 1087, 1088, 1089, 1090, 1091, 1092, 1093, 1094, 1095, 1096, 1097, 1098, 1099, 1100, 1101, 1102, 1103, 1104, 1105, 1106, 1107, 1108, 1109, 1110, 1111, 1112, 1113, 1114, 1115, 1116, 1117, 1118, 1119, 1120, 1121, 1122, 1123, 1124, 1125, 1126, 1127, 1128, 1129, 1130, 1131, 1132, 1133, 1134, 1135, 1136, 1137, 1138, 1139, 1140, 1141, 1142, 1143, 1144, 1145, 1146, 1147, 1148, 1149, 1150, 1151, 1152, 1153, 1154, 1155, 1156, 1157, 1158, 1159, 1160, 1161, 1162, 1163, 1164, 1165, 1166, 1167, 1168, 1169, 1170, 1171, 1172, 1173, 1174, 1175, 1176, 1177, 1178, 1179, 1180, 1181, 1182, 1183, 1184, 1185, 1186, 1187, 1188, 1189, 1190, 1191, 1192, 1193, 1194, 1195, 1196, 1197, 1198, 1199, 1200, 1201, 1202, 1203, 1204, 1205, 1206, 1207, 1208, 1209, 1210, 1211, 1212, 1213, 1214, 1215, 1216, 1217, 1218, 1219, 1220, 1221, 1222, 1223, 1224, 1225, 1226, 1227, 1228, 1229, 1230, 1231, 1232, 1233, 1234, 1235, 1236, 1237, 1238, 1239, 1240, 1241, 1242, 1243, 1244, 1245, 1246, 1247, 1248, 1249, 1250, 1251, 1252, 1253, 1254, 1255, 1256, 1257, 1258, 1259, 1260, 1261, 1262, 1263, 1264, 1265, 1266, 1267, 1268, 1269, 1270, 1271, 1272, 1273, 1274, 1275, 1276, 1277, 1278, 1279, and 1280, this can be used to diagnose or prognose slow-progressing liver fibrosis in a subject. In some examples, the upregulation is an increase of at least 0.1 fold, at least 0.5-fold, at least 1-fold, at least 1.5-fold, at least 2-fold, at least 2.5-fold, at least 3-fold, or at least 3.1-fold. In addition, if two or more of SEQ ID NOS: 1-767 are downregualted relative to a control (such as an amount of protein expression expected in a subject or population of subjects having non-progressing liver fibrosis), such as two or more of any of SEQ ID NOS: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 701, 702, 703, 704, 705, 706, 707, 708, 709, 710, 711, 712, 713, 714, 715, 716, 717, 718, 719, 720, 721, 722, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 753, 754, 755, 756, 757, 758, 759, 760, 761, 762, 763, 764, 765, 766, and 767, this can be used to diagnose or prognose slow-progressing liver fibrosis in a subject. In some examples, the downregulation is a decrease of at least 0.5 fold, at least 0.8 fold, at least 1-fold, at least 2-fold, at least 2.5-fold, at least 3-fold, at least 3.5-fold, or at least 4-fold.

TABLE 3

101 Liver Fibrosis Related Proteins with Differential Expression in Post-Transplant Slow-Progressing Liver Fibrosis relative to matched controls representing protein expression in a subject with non-progressing liver fibrosis

| Gene | Protein and UniProt Accession Number | Up-regulated | Down-regulated | Fold-Change vs. Control |
|---|---|---|---|---|
| PTPRG | P23470 Receptor-type tyrosine-protein phosphatase gamma | X | | At least 1.3-fold |
| QSOX1 | O00391 Sulfhydryl oxidase 1 | X | | At least 1.4-fold |
| GPX3 | P22352 Glutathione peroxidase 3 | X | | At least 1.2-fold |
| . | P04433 Ig kappa chain V-III region VG | X | | At least 2 fold |
| . | P18135 Ig kappa chain V-III region HAH | X | | At least 3.2-fold |
| . | P80748 Ig lambda chain V-III region LOI | X | | At least 2.6-fold |
| IGHA1 | P01876 Ig alpha-1 chain C region | X | | At least 4.9-fold |
| IGHG1 | P01857 Ig gamma-1 chain C region | X | | At least 3.6-fold |
| IGHG2 | P01859 Ig gamma-2 chain C region | X | | At least 2.8-fold |
| IGHM | P01871 Ig mu chain C region | X | | At least 3.0-fold |
| IGKC | P01834 Ig kappa chain C region | X | | At least 4.3-fold |
| IGKV1-5 | P01602 Ig kappa chain V-I region HK102 | X | | At least 2.3-fold |
| IGLC1 | P01842 Ig lambda chain C regions | X | | At least 4.2-fold |
| FCGR3A | P08637 Low affinity immunoglobulin gamma Fc region receptor III-A | X | | At least 1.5-fold |
| A2M | P01023 Alpha-2-macroglobulin | X | | At least 1.4-fold |
| ACTB | Q96HG5 Actin, cytoplasmic 1 | X | | At least 1.4-fold |
| AFM | P43652 Afamin | X | | At least 1.4-fold |
| AHSG | P02765 Alpha-2-HS-glycoprotein | X | | At least 1.3-fold |
| ALCAM | Q13740 CD166 antigen | X | | At least 1.3-fold |
| APOB | Q13787 Apolipoprotein B-100 | X | | At least 1.4-fold |
| APOE | P02649 Apolipoprotein E | X | | At least 1.5-fold |
| C7 | P10643 Complement component C7 | X | | At least 1.8-fold |
| CLU | P10909 Clusterin | X | | At least 1.3-fold |
| ECM1 | Q8IZ60 Extracellular matrix protein 1 | X | | At least 1.3-fold |
| HBB | Q549N7 Hemoglobin subunit beta | X | | At least 2.3-fold |
| ITIH3 | Q06033 Inter-alpha-trypsin inhibitor heavy chain H3 | X | | At least 1.2-fold |
| LGALS3BP | Q08380 Galectin-3-binding protein | X | | At least 1.5-fold |
| MBL2 | P11226 Mannose-binding protein C | X | | At least 1.7-fold |
| SELL | P14151 L-selectin | X | | At least 1.2-fold |
| SERPINA1 | Q86U18 Alpha-1-antitrypsin | X | | At least 3-fold |
| SERPINA6 | P08185 Corticosteroid-binding globulin | X | | At least 1.2-fold |
| SHBG | P04278 Sex hormone-binding globulin | X | | At least 1.5-fold |
| VCAM1 | P19320 Vascular cell adhesion protein 1 | X | | At least 1.3-fold |
| VWF | P04275 von Willebrand factor | X | | At least 1.3-fold |
| F2 | P00734 Prothrombin | | X | At least 1.2-fold |
| CFB | Q9BX92 Complement factor B | | X | At least 1.1-fold |
| CFI | P05156 Complement factor I | | X | At least 1.2-fold |
| C1S | Q9UCV4 Complement C1s subcomponent | | X | At least 1.3-fold |
| C1R | P00736 Complement C1r subcomponent | | X | At least 1.2-fold |
| KLKB1 | P03952 Plasma kallikrein | | X | At least 1.3-fold |
| F11 | P03951 Coagulation factor XI | | X | At least 1.5-fold |
| F9 | P00740 Coagulation factor IX | | X | At least 1.4-fold |
| CNDP1 | Q96KN2 Beta-Ala-His dipeptidase | | X | At least 1.8-fold |
| BCHE | P06276 Cholinesterase | | X | At least 1.5-fold |
| ALB | Q9P157 Serum albumin | | X | At least 1.9-fold |
| APCS | P02743 Serum amyloid P-component | | X | At least 1.5-fold |
| APOA4 | P06727 Apolipoprotein A-IV | | X | At least 1.1-fold |
| APOC3 | P02656 Apolipoprotein C-III | | X | At least 2.2-fold |
| APOH | P02749 Beta-2-glycoprotein 1 | | X | At least 1.4-fold |
| AZGP1 | P25311 Zinc-alpha-2-glycoprotein | | X | At least 1.2-fold |
| C4A | Q5JQM8 Complement C4-A | | X | At least 1.6-fold |
| C6 | P13671 Complement component C6 | | X | At least 1.2-fold |
| C8A | P07357 Complement component C8 alpha chain | | X | At least 1.3-fold |

TABLE 3-continued

101 Liver Fibrosis Related Proteins with Differential Expression in Post-Transplant Slow-Progressing Liver Fibrosis relative to matched controls representing protein expression in a subject with non-progressing liver fibrosis

| Gene | Protein and UniProt Accession Number | Up-regulated | Down-regulated | Fold-Change vs. Control |
|---|---|---|---|---|
| C8B | P07358 Complement component C8 beta chain | | X | At least 1.4-fold |
| C8G | P07360 Complement component C8 gamma chain | | X | At least 1.2-fold |
| C9 | P02748 Complement component C9 | | X | At least 1.2-fold |
| FGA | P02671 Fibrinogen alpha chain | | X | At least 4.0-fold |
| HPX | P02790 Hemopexin | | X | At least 1.3-fold |
| HRG | P04196 Histidine-rich glycoprotein | | X | At least 1.3-fold |
| IGFALS | P35858 Insulin-like growth factor-binding protein complex acid labile subunit | | X | At least 1.5-fold |
| ITIH1 | P19827 Inter-alpha-trypsin inhibitor heavy chain H1 | | X | At least 1.4-fold |
| ITIH2 | P19823 Inter-alpha-trypsin inhibitor heavy chain H2 | | X | At least 1.2-fold |
| ITIH4 | Q14624 Inter-alpha-trypsin inhibitor heavy chain H4 | | X | At least 1.2-fold |
| ORM1 | P02763 Alpha-1-acid glycoprotein 1 | | X | At least 2.3-fold |
| ORM2 | P19652 Alpha-1-acid glycoprotein 2 | | X | At least 2.1-fold |
| PRG4 | Q92954 Proteoglycan 4 | | X | At least 1.4-fold |
| RBP4 | P02753 Retinol-binding protein 4 | | X | At least 1.1-fold |
| SERPINA3 | Q6NSC9 Alpha-1-antichymotrypsin | | X | At least 1.1-fold |
| SERPINC1 | Q9UC78 Antithrombin-III | | X | At least 1.1-fold |
| SERPIND1 | P05546 Heparin cofactor 2 | | X | At least 1.4-fold |
| TTR | P02766 Transthyretin | | X | At least 2.2-fold |
| Proteins showing significant differential expression in opposite directions for Fast and Slow-Progressing Liver Fibrosis | | | | |
| F10 | P00742 Coagulation factor X | | X | At least 1.2-fold |
| FN1 | Q9HAP3 Fibronectin | | X | At least 1.5-fold |
| C5 | P01031 Complement C5 | | X | At least 1.1-fold |
| SERPINA4 | P29622 Kallistatin | | X | At least 1.2-fold |
| VTN | P04004 Vitronectin | | X | At least 1.1-fold |
| LUM | P51884 Lumican | | X | At least 2.6-fold |
| Proteins showing significant differential expression only in Slow-Progressing Liver Fibrosis | | | | |
| HBA1 | P69905 Hemoglobin subunit alpha | X | | At least 2.1-fold |
| SERPING1 | Q96FE0 Plasma protease C1 inhibitor | X | | At least 1.4-fold |
| . | P01594 Ig kappa chain V-I region AU | X | | At least 3-fold |
| . | P01614 Ig kappa chain V-II region Cum | X | | At least 3.2-fold |
| IGKV4-1 | P06312 Ig kappa chain V-IV region | X | | At least 3.3-fold |
| PGLYRP2 | Q96PD5 N-acetlmuramoyl-L-alanine amidase | | X | At least 1.2 fold |
| BTD | P43251 Biotinidase | | X | At least 1.2 fold |
| PLG | P00747 Plasminogen | | X | At least 1.1 fold |
| PROC | P04070 Vitamin K-dependent protein C | | X | At least 1.6 fold |
| C1RL | Q9NZP8 Complement C1r subcomponent-like protein | | X | At least 1.2 fold |
| CPN1 | P15169 Carboxypeptidase N catalytic chain | | X | At least 1.1 fold |
| CPB2 | Q96IY4 Carboxypeptidase B2 | | X | At least 1.2 fold |
| APOA1 | P02647 Apolipoprotein A-I* | | X | At least 1.5 fold |
| C4B | Q9UIP5 Complement C4-B | | X | At least 1.5 fold |
| GC | P02774 Vitamin D-binding protein | | X | At least 1.1 fold |
| GP5 | P40197 Platelet glycoprotein V | | X | At least 1.2 fold |
| HP | P00738 Haptoglobin | | X | At least 1.4 fold |
| IGFBP3 | P17936 Insulin-like growth factor-binding protein 3* | | X | At least 1.3 fold |
| KNG1 | P01042 Kininogen-1 | | X | At least 1.3 fold |
| PROS1 | P07225 Vitamin K-dependent protein S | | X | At least 1.3 fold |
| SERPINA10 | Q9UK55 Protein Z-dependent protease inhibitor | | X | At least 1.4 fold |
| SERPINF1 | P36955 Pigment epithelium-derived factor | | X | At least 1.2 fold |
| SERPINF2 | P08697 Alpha-2-antiplasmin | | X | At least 1.1 fold |
| THBS1 | P07996 Thrombospondin-1 | | X | At least 1.4 fold |

Table 4 summarizes the results in Tables 1-3. As indicated in Table 4, 77 proteins showed differential expression in both fast- and slow-progressing liver fibrosis (post-transplant subjects) with the differential expression having the same directionality for both groups in 71 out of 77 of the proteins. 34 proteins increased in the slow progressors (SP) and fast progressors (FP) compared to their matched controls, 37 proteins decreased in the SP and FP compared to their matched controls, 5 proteins only increased in the SP compared to their matched controls, 30 proteins only increased in the FP, 19 proteins only decreased in the SP, 5 proteins only decreased in the FP and 6 proteins increased in the FP and decreased in the SP.

TABLE 4

Summary of Transplant Patients with Fibrosis

|  | FP | SP |
|---|---|---|
| Slow Progressors (SP) | 34↑ 37↓ | 5↑ 19↓ |
| Fast Progressors (FP) | 30↑ 5↓ | 6 (↑FP↓SP) |
| Total Significantly Changing Proteins |  | 136 |

Table 5 provides directionality of differential expression for liver fibrosis-related proteins in non-transplant subjects having advanced liver fibrosis relative to controls with Stage 0-1 fibrosis. 40% of the proteins (31 out of 78 proteins) were up-regulated in the non-transplant subjects having advanced liver fibrosis and 60% of the proteins (47 out of 78 proteins) were down-regulated. 81% of the proteins in Table 5 (63 out of 78 proteins) also showed differential expression in the transplant group (i.e., appear in Table 1) with the majority (43 out of 78 proteins) being proteins showing differential expression in both slow- and fast-progressing post-transplant subjects (i.e., proteins appearing in both Table 2 and Table 3).

As discussed above, after excluding 4 proteins which decrease in SP, but increase in FP, >91% of the proteins with differential expression in the transplant group and non-transplant group are observed with common abundance directionality, providing a strong orthogonal validation of the proteins based upon both transplant and non-transplant studies. More extensive expression data, including data for specific peptides, is found in the Examples section below. Thus, expression of two or more of the liver fibrosis-related proteins (or corresponding peptides or nucleic acid molecules) in Table 5 can be used to diagnose or prognose liver fibrosis in a subject, such as by detecting expression of at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 31, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, at least 60, at least 61, at least 62, at least 63, at least 64, at least 65, at least 66, at least 67, at least 68, at least 69, at least 70, at least 71, at least 72, at least 73, at least 74, at least 75, at least 76, at least 77, or all 78 of the proteins (or corresponding peptides or nucleic acid molecules) in Table 5. For example, if at least two of the liver fibrosis-related molecules in Table 2 (such as at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 31, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, at least 60, at least 61, at least 62, at least 63, at least 64, at least 65, at least 66, at least 67, at least 68, at least 69, at least 70, at least 71, at least 72, at least 73, at least 74, at least 75, at least 76, at least 77, or all 78 of the proteins) show the relative amount and direction of differential expression in the test sample, relative to a control (such as an amount of protein expression expected in a subject or population of subjects having non-progressing liver fibrosis), this results in a diagnosis of liver fibrosis, or a prognosis that the subject will develop liver fibrosis in the future.

TABLE 5

78 Liver Fibrosis Related Proteins having Differential Expression in Non-Transplant Stage 4-6 Liver Fibrosis subjects relative to Controls representing protein expression in a Non-Transplant Stage 0-1 Liver Fibrosis subject.

| Gene | Protein | Direction of Differential Expression |
|---|---|---|
| QSOX1 | O00391 Sulfhydryl oxidase 1 | ↑ |
| IGLC1 | P01842 Ig lambda chain C regions | ↑ |
| FCGR3A | P08637 Low affinity immunoglobulin gamma Fc region receptor III-A | ↑ |
| A2M | P01023 Alpha-2-macroglobulin | ↑ |
| AFM | P43652 Afamin | ↑ |
| ALCAM | Q13740 CD166 antigen | ↑ |
| APOB* | Q13787 Apolipoprotein B-100 | ↓ |
| C7 | P10643 Complement component C7 | ↑ |
| CLU | P10909 Clusterin | ↓ |
| ECM1 | Q8IZ60 Extracellular matrix protein 1 | ↑ |
| ITIH3 | Q06033 Inter-alpha-trypsin inhibitor heavy chain H3 | ↑ |
| LGALS3BP | Q08380 Galectin-3-binding protein | ↑ |
| VCAM1 | P19320 Vascular cell adhesion protein 1 | ↑ |
| VWF | P04275 von Willebrand factor | ↑ |
| F2 | P00734 Prothrombin | ↓ |
| CFI | P05156 Complement factor I | ↓ |
| KLKB1 | P03952 Plasma kallikrein | ↓ |
| F11 | P03951 Coagulation factor XI | ↓ |
| CNDP1 | Q96KN2 Beta-Ala-His dipeptidase | ↓ |
| BCHE | P06276 Cholinesterase | ↓ |
| APCS | P02743 Serum amyloid P-component | ↓ |
| APOH | P02749 Beta-2-glycoprotein 1 | ↓ |
| AZGP1 | P25311 Zinc-alpha-2-glycoprotein | ↓ |
| C4A | Q5JQM8 Complement C4-A | ↓ |
| C6 | P13671 Complement component C6 | ↓ |
| C8A | P07357 Complement component C8 alpha chain | ↓ |
| C8B | P07358 Complement component C8 beta chain | ↓ |
| C8G | P07360 Complement component C8 gamma chain | ↓ |
| HPX | P02790 Hemopexin | ↓ |
| IGFALS | P35858 Insulin-like growth factor-binding protein complex acid labile subunit | ↓ |
| ITIH1 | P19827 Inter-alpha-trypsin inhibitor heavy chain H1 | ↓ |
| ITIH2 | P19823 Inter-alpha-trypsin inhibitor heavy chain H2 | ↓ |
| ITIH4 | Q14624 Inter-alpha-trypsin inhibitor heavy chain H4 | ↓ |
| PRG4 | Q92954 Proteoglycan 4 | ↓ |
| RBP4 | P02753 Retinol-binding protein 4 | ↓ |
| SERPINC1 | Q9UC78 Antithrombin-III | ↓ |
| SERPIND1 | P05546 Heparin cofactor 2 | ↓ |
| TTR | P02766 Transthyretin | ↓ |
| APOC3 | P02656 Apolipoprotein C-III | ↓ |
| F10 | P00742 Coagulation factor X | ↓ |

TABLE 5-continued

78 Liver Fibrosis Related Proteins having Differential Expression in Non-Transplant Stage 4-6 Liver Fibrosis subjects relative to Controls representing protein expression in a Non-Transplant Stage 0-1 Liver Fibrosis subject.

| Gene | Protein | Direction of Differential Expression |
|---|---|---|
| SERPINA4 | P29622 Kallistatin | ↓ |
| VTN | P04004 Vitronectin | ↑ |
| LUM | P51884 Lumican | ↑ |
| SERPING1 | Q96FE0 Plasma protease C1 inhibitor | ↑ |
| BTD | P43251 Biotinidase | ↓ |
| PLG | P00747 Plasminogen | ↓ |
| PROC | P04070 Vitamin K-dependent protein C | ↓ |
| CPN1 | P15169 Carboxypeptidase N catalytic chain | ↓ |
| CPB2 | Q96IY4 Carboxypeptidase B2 | ↓ |
| GC | P02774 Vitamin D-binding protein | ↓ |
| GP5 | P40197 Platelet glycoprotein V | ↓ |
| C2 | P06681 Complement C2 | ↓ |
| F12 | P00748 Coagulation factor XII | ↓ |
| ANPEP | P15144 Aminopeptidase N | ↑ |
| CP | P00450 Ceruloplasmin | ↑ |
| TGFBI | Q53XM1 Transforming growth factor-beta-induced protein ig-h3 | ↑ |
| FCGBP | Q9Y6R7 IgGFc-binding protein | ↑ |
| SERPINA7 | P05543 Thyroxine-binding globulin | ↓ |
| PVR | P15151 Poliovirus receptor | ↑ |
| AGT | P01019 Angiotensinogen | ↓ |
| H6PD | O95479 GDH/6PGL endoplasmic bifunctional protein | ↓ |
| PROCR | Q9UNN8 Endothelial protein C receptor | ↑ |
| VASN | Q6EMK4 Vasorin | ↑ |
| — | Ig lambda chain V-I region NEWM | ↑ |
| APOC1 | P02654 Apolipoprotein C-I | ↑ |
| ICAM1 | P05362 Intercellular adhesion molecule 1 | ↑ |
| CSF1R | P07333 Macrophage colony-stimulating factor 1 receptor | ↑ |
| DBH | P09172 Dopamine beta-hydroxylase | ↑ |
| COL6A3 | P12111 Collagen alpha-3(VI) chain | ↑ |
| COMP | P49747 Cartilage oligomeric matrix protein | ↑ |
| CD163 | Q86VB7 Scavenger receptor cysteine-rich type 1 protein M130 | ↑ |
| LYVE1 | Q9Y5Y7 Lymphatic vessel endothelial hyaluronic acid receptor 1 | ↑ |
| LCAT | P04180 Phosphatidylcholine-sterol acyltransferase | ↓ |
| CPN2 | P22792 Carboxypeptidase N subunit 2 | ↓ |
| PROZ | P22891 Vitamin K-dependent protein Z | ↓ |
| MASP1 | P48740 Mannan-binding lectin serine protease 1 | ↓ |
| SEPP1 | P49908 Selenoprotein P | ↓ |
| RARRES2 | Q99969 Retinoic acid receptor responder protein 2 | ↓ |

Table 6 lists the liver fibrosis-related proteins with differential expression only in fast-progressing (FP) post-transplant patients or only in slow-progressing (SP) post-transplant patients relative to controls representing protein expression in a patient with non-progressing liver fibrosis that also show differential expression in the same direction in non-transplant Stage 4-6 Liver Fibrosis subjects relative to Controls representing protein expression in a non-transplant Stage 0-1 Liver Fibrosis subject. Excluded from Table 6 are two proteins, F12 and Serpina7, which showed differential expression but in the opposite direction from the differential expression detected in SP or FP post-transplant subjects. Thus, for 90% (18 out of 20 proteins) of proteins with differential expression only in FP or SP that also showed differential expression in non-transplant patients, the differential expression was in the same direction as was detected for FP or SP post-transplant patients. 10 of the proteins in Table 6 show differential expression only in FP post-transplant patients, and 8 of the proteins in Table 6 show differential expression only in SP post-transplant patients.

TABLE 6

Liver Fibrosis Related Proteins with Differential Expression in only Fast-Progressing (FP) Post-Transplant Patients or only Slow-Progressing (SP) Post-Transplant patients relative to Controls representing protein expression in a patient with Non-Progressing Liver Fibrosis that show Differential Expression in the same direction in Non-Transplant Stage 4-6 Liver Fibrosis subjects relative to Controls representing protein expression in a Non-Transplant Stage 0-1 Liver Fibrosis subject.

A. Proteins with Differential Expression only in SP Post-Transplant Subjects that have co-directional Differential Expression in Non-Transplant Stage 4-6 Subjects

| | | |
|---|---|---|
| SERPING1 | Q96FE0 Plasma protease C1 inhibitor | ↑ |
| BTD | P43251 Biotinidase | ↓ |
| PLG | P00747 Plasminogen | ↓ |
| PROC | P04070 Vitamin K-dependent protein C | ↓ |
| CPN1 | P15169 Carboxypeptidase N catalytic chain | ↓ |
| CPB2 | Q96IY4 Carboxypeptidase B2 | ↓ |
| GC | P02774 Vitamin D-binding protein | ↓ |
| GP5 | P40197 Platelet glycoprotein V | ↓ |

B. Proteins with Differential Expression only in FP Post-Transplant Subjects that have co-directional Differential Expression in Non-Transplant Stage 4-6 Subjects

| | | |
|---|---|---|
| C2 | P06681 Complement C2 | ↓ |
| ANPEP | P15144 Aminopeptidase N | ↑ |
| CP | P00450 Ceruloplasmin | ↑ |
| TGFBI | Q53XM1 Transforming growth factor-beta-induced protein ig-h3 | ↑ |
| FCGBP | Q9Y6R7 IgGFc-binding protein | ↑ |
| PVR | P15151 Poliovirus receptor | ↑ |
| AGT | P01019 Angiotensinogen | ↓ |
| H6PD | O95479 GDH/6PGL endoplasmic bifunctional protein | ↓ |
| PROCR | Q9UNN8 Endothelial protein C receptor | ↑ |
| VASN | Q6EMK4 Vasorin | ↑ |

In a specific example, expression of two or more of the liver fibrosis-related proteins (or corresponding peptides or nucleic acid molecules) labeled under "Proteins with Differential Expression only in FP Post-Transplant Subjects that have co-directional Differential Expression in Non-Transplant Stage 4-6 Subjects" in Table 6 can be used to diagnose or prognose fast-progressing liver fibrosis in a subject, such as by detecting expression of at least 3, at least 4, at least 5, at least 6, at least 7, at least 8, at least 9, at least 10 such proteins (or corresponding peptides or nucleic acid molecules) in Table 6. For example, if at least two of the liver fibrosis-related molecules in Table 6 (such as at least 3, at least 4, at least 5, at least 6, at least 7, at least 8, at least 9, or all 10 labeled under "Proteins with Differential Expression only in FP Post-Transplant Subjects that have co-directional Differential Expression in Non-Transplant Stage 4-6 Subjects") show differential expression in the test sample, relative to a control (such as an amount of protein expression expected in a subject or population of subjects having non-progressing liver fibrosis), this results in a diagnosis of fast-progressing liver fibrosis, or a prognosis that the subject will develop a fast-progressing liver fibrosis in the future.

In a specific example, expression of two or more of the liver fibrosis-related proteins (or corresponding peptides or nucleic acid molecules) labeled under "Proteins with Differential Expression only in SP Post-Transplant Subjects that have co-directional Differential Expression in Non-Transplant Stage 4-6 Subjects" in Table 6 can be used to diagnose or prognose slow-progressing liver fibrosis in a subject, such as by detecting expression of at least 3, at least 4, at least 5, at least 6, at least 7, or all 8 such proteins (or corresponding peptides or nucleic acid molecules) in Table 6. For example, if at least two of the liver fibrosis-related molecules in Table 6 (such as at least 3, at least 4, at least 5, at least 6, at least 7, or all 8 labeled under "Proteins with Differential Expression only in SP Post-Transplant Subjects that have co-directional Differential Expression in Non-Transplant Stage 4-6 Subjects") show differential expression in the test sample, relative to a control (such as an amount of protein expression expected in a subject or population of subjects having non-progressing liver fibrosis), this results in a diagnosis of slow-progressing liver fibrosis, or a prognosis that the subject will develop a slow-progressing liver fibrosis in the future.

IV. Progression of Liver Fibrosis

Rates of liver fibrosis progression can be described as fast, slow or non-progressing. In general, fast-progressing liver fibrosis progresses to an advanced stage (e.g., Stage 3-4 liver fibrosis) over a time period shorter than expected. Slow-progressing liver fibrosis progresses to an advanced stage over a time period longer than expected, and non-progressing liver fibrosis does not progress to an advanced stage of liver fibrosis over the course of a reasonable monitoring period. The expected rate of progression to liver fibrosis may depend upon the underlying cause. For example, in subjects having undergone liver transplantation, subjects may be categorized as having non-progressing liver fibrosis if no or mild return of fibrosis occurs over a time period of 2-4 years post-liver transplant. Subjects with slow progressing liver fibrosis may develop stage 3-4 fibrosis at three to four years post-transplant. Finally, subjects with fast progressing liver fibrosis may develop Stage 3-4 liver fibrosis within two years post-transplant.

Progression to liver fibrosis and advanced liver fibrosis may occur on a different schedule for subjects having other conditions causing liver fibrosis such as HCV infection (in a non-transplant subject), HBV infection, non-alcoholic fatty liver disease (NAFLD), Wilson's disease, alpha-1-antitrypsin deficiency, hemochromatosis, primary biliary cirrhosis, primary sclerosing cholangitis, and autoimmune hepatitis. For example, for a non-transplant subject infected with HCV, the expectation may be set according to the individual's age at the time of infection with HCV based on Poynard's fibrosis progression model (Poynard et al., 2001. *J. Hepatol.* 34: 730-9). For example, according to the Poynard model, a normal rate of progression to liver fibrosis in an individual younger than 20 years of age is 40 years. On the other hand, individuals who are infected at the age of 40 or older will develop liver fibrosis following 10-20 years from the time of infection. For a patient infected with HCV, this expectation may be set according to the Poynard fibrosis progression model discussed above. Accordingly, fast progressing liver fibrosis for a subject infected with HCV may refer to the development of liver fibrosis (e.g., stage 3 or higher) within a time period which is at least 5 years shorter than expected for a patient. Likewise, slow progressing liver fibrosis may refer to fibrosis which occurs over a time period which is at least 5 years longer than expected for a subject. Non-progressing liver fibrosis may refer to fibrosis which fails to develop or only manifests as mild fibrosis (e.g., stage 2 or lower) within a reasonable monitoring period. Based on the observation that fast-progression and slow-progression to fibrosis occurs over a time period that may depend on liver fibrosis cause, in various embodiments, fast-progression indicates progression to moderate or advanced liver fibrosis within less than 2 years, less than 3 years, less than 5 years, less than 10 years, less than 15 years, less than 20 years, less than 25 years, less than 30 years, or less than 40 years from a causative event or onset of a causative condition, such as 1 to 5 years, 1 to 10 years, or 2 to 20 years. Likewise, in various embodiments, slow-progressing liver fibrosis indicates progression to moderate or advanced liver fibrosis more than 2 years, more than 3 years, more than 5 years, more than 10 years, more than 15 years, more than 20 years, more than 25 years, more than 30 years, or more than 40 years after a causative event or onset of a causative condition, such as 2 to 5 years, 2 to 10 years, or 5 to 20 years.

The median estimated duration from the HCV infection date to the appearance of cirrhosis (end-stage liver fibrosis) is 30 years and approximately 33% of the patients progress to cirrhosis in less than 20 years (Poynard et al., 1997; *Lancet.* 349: 825-32). This indicates substantial variation in fibrosis progression rate and suggests that several host factors (e.g., factors related to the infected individual and not HCV itself), contribute to fibrosis progression. For example, older age, male gender, alcohol intake and immunosuppressant therapy can be associated with a less favorable outcome in terms of liver fibrosis [Poynard, supra]. Additionally, genetic factors can determine the natural history of liver diseases and the progression of liver fibrosis. These include genetic polymorphisms in genes encoding immuno-regulatory proteins, proinflammatory cytokines, and fibrogenic factors (Bataller et al., 2003. *Hepatology.* 37:493-503).

V. Detection of Liver Fibrosis-Related Nucleic Acid and Protein Molecules

The samples obtained from the subject (for example a serum or plasma sample) can contain altered levels of one or more nucleic acids or proteins associated with liver fibrosis, such as those listed in any of Tables 1, 2, 3, 5, 6 and 12, as well as any of SEQ ID NOS: 1-5544. Relative changes in expression or detected amounts can be detected to determine if a subject is predisposed to developing liver fibrosis, or has liver fibrosis. Although much of the disclosure focuses on detection of liver fibrosis-related proteins, one skilled in the art will appreciate that corresponding nucleic acid molecules (such as RNA, mRNA, DNA or cDNA) can be detected as a means to determine if expression of liver fibrosis-related molecules is altered. The present disclosure is not limited to particular methods of detecting proteins or nucleic acid molecules. Any method of detecting a nucleic acid molecule or protein can be used, such as physical or functional assays.

For example, the level of gene expression can be measured and quantified utilizing methods well known in the art, such as Northern-Blots, RNase protection assays, nucleic acid or antibody probe arrays, quantitative PCR (such as TaqMan assays), dot blot assays, in-situ hybridization, or combinations thereof. Using known techniques, a nucleic acid molecule may be first amplified prior to detection. In various embodiments, amplification of a nucleic acid or detection of a nucleic acid may be performed using a manual or automated technique or instrument. In addition, proteins can be detected or measured using immunological methods (such as antibody arrays [for example a lateral flow device, such as a point-of-care device, or an ELISA] or immunohistochemistry methods), quantitative spectroscopic methods (for example mass spectrometry, such as liquid chromatography ion mobility mass spectrometry (LC-IMS-MS), surface-enhanced laser desorption/ionization (SELDI)-based mass spectrometry or multiple reaction monitoring (MRM) based tandem mass spectrometry), or combinations thereof. In various embodiments, the expression level of a whole protein including the level of differential expression versus a control may be determined by detecting peptide fragments of the whole protein. In various embodiments detection of protein or fragment thereof may be performed using a manual or automated technique or instrument.

Methods for labeling nucleic acid molecules and proteins, as well as antibodies, so that they can be detected are well known. Examples of such labels include non-radiolabels and radiolabels. Non-radiolabels include, but are not limited to enzymes, chemiluminescent compounds, fluorophores, metal complexes, haptens, colorimetric agents, dyes, or combinations thereof. Radiolabels include, but are not limited to, $^{125}$I and $^{35}$S. Radioactive and fluorescent labeling methods, as well as other methods known in the art, are suitable for use with the present disclosure. In one example, the primers used to amplify the subject's nucleic acids are labeled (such as with biotin, a radiolabel, or a fluorophore), thereby permitting detection of the amplicons. In another example, the amplified nucleic acid samples are end-labeled to form labeled amplified material. For example, amplified nucleic acid molecules can be labeled by including labeled nucleotides in the amplification reactions. In another example, nucleic acid molecules obtained from a subject are labeled, and applied to an array containing oligonucleotides. In a particular example, proteins obtained from a subject are labeled and subsequently analyzed, for example by applying them to an array.

In one example, a biological sample from the subject is assayed for an increase or decrease in expression of liver fibrosis related molecules, such as 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 701, 702, 703, 704, 705, 706, 707, 708, 709, 710, 711, 712, 713, 714, 715, 716, 717, 718, 719, 720, 721, 722, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 847, 848, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 903, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, 950, 951, 952, 953, 954, 955, 956, 957, 958, 959, 960, 961, 962, 963, 964, 965, 966, 967, 968, 969, 970, 971, 972, 973, 974, 975, 976, 977, 978, 979, 980, 981, 982, 983, 984, 985, 986, 987, 988, 989, 990, 991, 992, 993, 994, 995, 996, 997, 998, 999, 1000, 1001, 1002, 1003, 1004, 1005, 1006, 1007, 1008, 1009, 1010, 1011, 1012, 1013, 1014, 1015, 1016, 1017, 1018, 1019, 1020, 1021, 1022, 1023, 1024, 1025, 1026, 1027, 1028, 1029, 1030, 1031, 1032, 1033, 1034, 1035, 1036, 1037, 1038, 1039, 1040, 1041, 1042, 1043, 1044, 1045, 1046, 1047, 1048, 1049, 1050, 1051, 1052, 1053, 1054, 1055, 1056, 1057, 1058, 1059, 1060, 1061, 1062, 1063, 1064, 1065, 1066, 1067, 1068, 1069, 1070, 1071, 1072, 1073, 1074, 1075, 1076, 1077, 1078, 1079, 1080, 1081, 1082, 1083, 1084, 1085, 1086, 1087, 1088, 1089, 1090, 1091, 1092, 1093, 1094, 1095, 1096, 1097, 1098, 1099, 1100, 1101, 1102, 1103, 1104, 1105, 1106, 1107, 1108, 1109, 1110, 1111, 1112, 1113, 1114, 1115, 1116, 1117, 1118, 1119, 1120, 1121, 1122, 1123, 1124, 1125, 1126, 1127, 1128, 1129, 1130, 1131, 1132, 1133, 1134, 1135, 1136, 1137, 1138, 1139, 1140, 1141, 1142, 1143, 1144, 1145, 1146, 1147, 1148, 1149, 1150, 1151, 1152, 1153, 1154, 1155, 1156, 1157, 1158, 1159, 1160, 1161, 1162, 1163, 1164, 1165, 1166, 1167, 1168, 1169, 1170, 1171, 1172, 1173, 1174, 1175, 1176, 1177, 1178, 1179, 1180, 1181, 1182, 1183, 1184, 1185, 1186, 1187, 1188, 1189, 1190, 1191, 1192, 1193, 1194, 1195, 1196, 1197, 1198, 1199, 1200, 1201, 1202, 1203, 1204, 1205, 1206, 1207, 1208, 1209, 1210, 1211, 1212, 1213, 1214, 1215, 1216, 1217, 1218, 1219, 1220, 1221, 1222, 1223, 1224, 1225, 1226, 1227, 1228, 1229, 1230, 1231, 1232, 1233, 1234, 1235, 1236, 1237, 1238, 1239, 1240, 1241, 1242, 1243, 1244, 1245, 1246, 1247, 1248, 1249, 1250, 1251, 1252, 1253, 1254, 1255, 1256, 1257, 1258, 1259, 1260, 1261, 1262, 1263, 1264, 1265, 1266, 1267, 1268, 1269, 1270, 1271, 1272, 1273, 1274, 1275, 1276, 1277, 1278, 1279, 1280, 1281, 1282, 1283, 1284, 1285, 1286, 1287, 1288, 1289, 1290, 1291, 1292, 1293, 1294, 1295, 1296, 1297, 1298, 1299, 1300, 1301, 1302, 1303, 1304, 1305, 1306, 1307, 1308, 1309, 1310, 1311, 1312, 1313, 1314, 1315, 1316, 1317, 1318, 1319, 1320, 1321, 1322, 1323, 1324, 1325, 1326, 1327, 1328, 1329, 1330, 1331, 1332, 1333, 1334, 1335, 1336, 1337, 1338, 1339, 1340, 1341, 1342, 1343, 1344, 1345, 1346, 1347, 1348, 1349, 1350, 1351, 1352, 1353, 1354, 1355, 1356, 1357, 1358, 1359, 1360, 1361, 1362, 1363, 1364, 1365, 1366, 1367, 1368, 1369, 1370, 1371, 1372, 1373, 1374, 1375, 1376, 1377, 1378, 1379, 1380, 1381, 1382, 1383, 1384, 1385, 1386, 1387, 1388, 1389, 1390, 1391, 1392, 1393, 1394, 1395, 1396, 1397, 1398, 1399, 1400, 1401, 1402, 1403, 1404, 1405, 1406, 1407, 1408, 1409, 1410, 1411, 1412, 1413, 1414, 1415, 1416, 1417, 1418, 1419, 1420, 1421, 1422, 1423, 1424, 1425, 1426, 1427, 1428, 1429, 1430, 1431, 1432, 1433, 1434, 1435, 1436, 1437, 1438, 1439, 1440, 1441, 1442, 1443, 1444, 1445, 1446, 1447, 1448, 1449, 1450, 1451, 1452, 1453, 1454, 1455, 1456, 1457, 1458, 1459, 1460, 1461, 1462, 1463, 1464, 1465, 1466, 1467, 1468, 1469, 1470, 1471, 1472, 1473, 1474, 1475, 1476, 1477, 1478, 1479, 1480, 1481, 1482, 1483, 1484, 1485, 1486, 1487, 1488, 1489, 1490, 1491, 1492, 1493, 1494, 1495, 1496, 1497, 1498, 1499, 1500, 1501, 1502, 1503, 1504, 1505, 1506, 1507, 1508, 1509, 1510, 1511, 1512, 1513, 1514, 1515, 1516, 1517, 1518, 1519, 1520, 1521, 1522, 1523, 1524, 1525, 1526, 1527, 1528, 1529, 1530, 1531, 1532, 1533, 1534, 1535, 1536, 1537, 1538, 1539, 1540, 1541, 1542, 1543, 1544, 1545, 1546, 1547, 1548, 1549, 1550, 1551, 1552, 1553, 1554, 1555, 1556, 1557, 1558, 1559, 1560, 1561, 1562, 1563, 1564, 1565, 1566, 1567, 1568, 1569, 1570, 1571, 1572, 1573, 1574, 1575, 1576, 1577, 1578, 1579, 1580, 1581, 1582, 1583, 1584, 1585, 1586, 1587, 1588, 1589, 1590, 1591, 1592, 1593, 1594, 1595, 1596, 1597, 1598, 1599, 1600, 1601, 1602, 1603, 1604, 1605, 1606, 1607, 1608, 1609, 1610, 1611, 1612, 1613, 1614, 1615, 1616, 1617, 1618, 1619, 1620, 1621, 1622, 1623, 1624, 1625, 1626, 1627, 1628, 1629, 1630, 1631, 1632, 1633, 1634, 1635, 1636, 1637, 1638, 1639, 1640, 1641, 1642, 1643, 1644, 1645, 1646, 1647, 1648, 1649, 1650, 1651, 1652, 1653, 1654, 1655, 1656, 1657, 1658, 1659, 1660, 1661, 1662, 1663, 1664, 1665, 1666, 1667, 1668, 1669, 1670, 1671, 1672, 1673, 1674, 1675, 1676, 1677, 1678, 1679, 1680, 1681, 1682, 1683, 1684, 1685, 1686, 1687, 1688, 1689, 1690, 1691, 1692, 1693, 1694, 1695, 1696, 1697, 1698, 1699, 1700, 1701, 1702, 1703, 1704, 1705, 1706, 1707, 1708, 1709, 1710, 1711, 1712, 1713, 1714, 1715, 1716, 1717, 1718, 1719, 1720, 1721, 1722, 1723, 1724, 1725, 1726, 1727, 1728, 1729, 1730, 1731, 1732, 1733, 1734, 1735, 1736, 1737, 1738, 1739, 1740, 1741, 1742, 1743, 1744, 1745, 1746, 1747, 1748, 1749, 1750, 1751, 1752, 1753, 1754, 1755, 1756, 1757, 1758, 1759, 1760, 1761, 1762, 1763, 1764, 1765, 1766, 1767, 1768, 1769, 1770, 1771, 1772, 1773, 1774, 1775, 1776, 1777, 1778, 1779, 1780, 1781, 1782, 1783, 1784, 1785, 1786, 1787, 1788, 1789, 1790, 1791, 1792, 1793, 1794, 1795, 1796, 1797, 1798, 1799, 1800, 1801, 1802, 1803, 1804, 1805, 1806, 1807, 1808, 1809, 1810, 1811, 1812, 1813, 1814, 1815, 1816, 1817, 1818, 1819, 1820, 1821, 1822, 1823, 1824, 1825, 1826, 1827, 1828, 1829, 1830, 1831, 1832, 1833, 1834, 1835, 1836, 1837, 1838, 1839, 1840, 1841, 1842, 1843, 1844, 1845, 1846, 1847, 1848, 1849, 1850, 1851, 1852, 1853, 1854, 1855, 1856, 1857, 1858, 1859, 1860, 1861, 1862, 1863, 1864, 1865, 1866, 1867, 1868, 1869, 1870, 1871, 1872, 1873, 1874, 1875, 1876, 1877, 1878, 1879, 1880, 1881, 1882, 1883, 1884, 1885, 1886, 1887, 1888, 1889, 1890, 1891, 1892, 1893, 1894, 1895, 1896, 1897, 1898, 1899, 1900, 1901, 1902, 1903, 1904, 1905, 1906, 1907, 1908, 1909, 1910, 1911, 1912, 1913, 1914, 1915, 1916, 1917, 1918, 1919, 1920, 1921, 1922, 1923, 1924, 1925, 1926, 1927, 1928, 1929, 1930, 1931, 1932, 1933, 1934, 1935, 1936, 1937, 1938, 1939, 1940, 1941, 1942, 1943, 1944, 1945, 1946, 1947, 1948, 1949, 1950, 1951, 1952, 1953, 1954, 1955, 1956, 1957, 1958, 1959, 1960, 1961, 1962, 1963, 1964, 1965, 1966, 1967, 1968, 1969, 1970, 1971, 1972, 1973, 1974, 1975, 1976, 1977, 1978, 1979, 1980, 1981, 1982, 1983, 1984, 1985, 1986, 1987, 1988, 1989, 1990, 1991, 1992, 1993, 1994, 1995, 1996, 1997, 1998, 1999, 2000, 2001, 2002, 2003, 2004, 2005, 2006, 2007, 2008, 2009, 2010, 2011, 2012, 2013, 2014, 2015, 2016, 2017, 2018, 2019, 2020, 2021, 2022, 2023, 2024, 2025, 2026, 2027, 2028, 2029, 2030, 2031, 2032, 2033, 2034, 2035, 2036, 2037, 2038, 2039, 2040, 2041, 2042, 2043, 2044, 2045, 2046, 2047, 2048, 2049, 2050, 2051, 2052, 2053, 2054, 2055, 2056, 2057, 2058, 2059, 2060, 2061, 2062, 2063, 2064, 2065, 2066, 2067, 2068, 2069, 2070, 2071, 2072, 2073, 2074, 2075, 2076, 2077, 2078, 2079, 2080, 2081, 2082, 2083, 2084, 2085, 2086, 2087, 2088, 2089, 2090, 2091, 2092, 2093, 2094, 2095, 2096, 2097, 2098, 2099, 2100, 2101, 2102, 2103, 2104, 2105, 2106, 2107, 2108, 2109, 2110, 2111, 2112, 2113, 2114, 2115, 2116, 2117, 2118, 2119, 2120, 2121, 2122, 2123, 2124, 2125, 2126, 2127, 2128, 2129, 2130, 2131, 2132, 2133, 2134, 2135, 2136, 2137, 2138, 2139, 2140, 2141, 2142, 2143, 2144, 2145, 2146, 2147, 2148, 2149, 2150, 2151, 2152, 2153, 2154, 2155, 2156, 2157, 2158, 2159, 2160, 2161, 2162, 2163, 2164, 2165, 2166, 2167, 2168, 2169, 2170, 2171, 2172, 2173, 2174, 2175, 2176, 2177, 2178, 2179, 2180, 2181, 2182, 2183, 2184, 2185, 2186, 2187, 2188, 2189, 2190, 2191, 2192, 2193, 2194, 2195, 2196, 2197, 2198, 2199, 2200, 2201, 2202, 2203, 2204, 2205, 2206, 2207, 2208, 2209, 2210, 2211, 2212, 2213, 2214, 2215, 2216, 2217, 2218, 2219, 2220, 2221, 2222, 2223, 2224, 2225, 2226, 2227, 2228, 2229, 2230, 2231, 2232, 2233, 2234, 2235, 2236, 2237, 2238, 2239, 2240, 2241, 2242, 2243, 2244, 2245, 2246, 2247, 2248, 2249, 2250, 2251, 2252, 2253, 2254, 2255, 2256, 2257, 2258, 2259, 2260, 2261, 2262, 2263, 2264, 2265, 2266, 2267, 2268, 2269, 2270, 2271, 2272, 2273, 2274, 2275, 2276, 2277, 2278, 2279, 2280, 2281, 2282, 2283, 2284, 2285, 2286, 2287, 2288, 2289, 2290, 2291, 2292, 2293, 2294, 2295, 2296, 2297, 2298, 2299, 2300, 2301, 2302, 2303, 2304, 2305, 2306, 2307, 2308, 2309, 2310, 2311, 2312, 2313, 2314, 2315, 2316, 2317, 2318, 2319, 2320, 2321, 2322, 2323, 2324, 2325, 2326, 2327, 2328, 2329, 2330, 2331, 2332, 2333, 2334, 2335, 2336, 2337, 2338, 2339, 2340, 2341, 2342, 2343, 2344, 2345, 2346, 2347, 2348, 2349, 2350, 2351, 2352, 2353, 2354, 2355, 2356, 2357, 2358, 2359, 2360, 2361, 2362, 2363, 2364, 2365, 2366, 2367, 2368, 2369, 2370, 2371, 2372, 2373, 2374, 2375, 2376, 2377, 2378, 2379, 2380, 2381, 2382, 2383, 2384, 2385, 2386, 2387, 2388, 2389, 2390, 2391, 2392, 2393, 2394, 2395, 2396, 2397, 2398, 2399, 2400, 2401, 2402, 2403, 2404, 2405, 2406, 2407, 2408, 2409, 2410, 2411, 2412, 2413, 2414, 2415, 2416, 2417, 2418, 2419, 2420, 2421, 2422, 2423, 2424, 2425, 2426, 2427, 2428, 2429, 2430, 2431, 2432, 2433, 2434, 2435, 2436, 2437, 2438, 2439, 2440, 2441, 2442, 2443, 2444, 2445, 2446, 2447, 2448, 2449, 2450, 2451, 2452, 2453, 2454, 2455, 2456, 2457, 2458, 2459, 2460, 2461, 2462, 2463, 2464, 2465, 2466, 2467, 2468, 2469, 2470, 2471, 2472, 2473, 2474, 2475, 2476, 2477, 2478, 2479, 2480, 2481, 2482, 2483, 2484, 2485, 2486, 2487, 2488, 2489, 2490, 2491, 2492, 2493, 2494, 2495, 2496, 2497, 2498, 2499, 2500, 2501, 2502, 2503, 2504, 2505, 2506, 2507, 2508, 2509, 2510, 2511, 2512, 2513, 2514, 2515, 2516, 2517, 2518, 2519, 2520, 2521, 2522, 2523, 2524, 2525, 2526, 2527, 2528, 2529, 2530, 2531, 2532, 2533, 2534, 2535, 2536, 2537, 2538, 2539, 2540, 2541, 2542, 2543, 2544, 2545, 2546, 2547, 2548, 2549, 2550, 2551, 2552, 2553, 2554, 2555, 2556, 2557, 2558, 2559, 2560, 2561, 2562, 2563, 2564, 2565, 2566, 2567, 2568, 2569, 2570, 2571, 2572, 2573, 2574, 2575, 2576, 2577, 2578, 2579, 2580, 2581, 2582, 2583, 2584, 2585, 2586, 2587, 2588, 2589, 2590, 2591, 2592, 2593, 2594, 2595, 2596, 2597, 2598, 2599, 2600, 2601, 2602, 2603, 2604, 2605, 2606, 2607, 2608, 2609, 2610, 2611, 2612, 2613, 2614, 2615, 2616, 2617, 2618, 2619, 2620, 2621, 2622, 2623, 2624, 2625, 2626, 2627, 2628, 2629, 2630, 2631, 2632, 2633, 2634, 2635, 2636, 2637, 2638, 2639, 2640, 2641, 2642, 2643, 2644, 2645, 2646, 2647, 2648, 2649, 2650, 2651, 2652, 2653, 2654, 2655, 2656, 2657, 2658, 2659, 2660, 2661, 2662, 2663, 2664, 2665, 2666, 2667, 2668, 2669, 2670, 2671, 2672, 2673, 2674, 2675, 2676, 2677, 2678, 2679, 2680, 2681, 2682, 2683, 2684, 2685, 2686, 2687, 2688, 2689, 2690, 2691, 2692, 2693, 2694, 2695, 2696, 2697, 2698, 2699, 2700, 2701, 2702, 2703, 2704, 2705, 2706, 2707, 2708, 2709, 2710, 2711, 2712, 2713, 2714, 2715, 2716, 2717, 2718, 2719, 2720, 2721, 2722, 2723, 2724, 2725, 2726, 2727, 2728, 2729, 2730, 2731, 2732, 2733, 2734, 2735, 2736, 2737, 2738, 2739, 2740, 2741, 2742, 2743, 2744, 2745, 2746, 2747, 2748, 2749, 2750, 2751, 2752, 2753, 2754, 2755, 2756, 2757, 2758, 2759, 2760, 2761, 2762, 2763, 2764, 2765, 2766, 2767, 2768, 2769, 2770, 2771, 2772, 2773, 2774, 2775, 2776, 2777, 2778, 2779, 2780, 2781, 2782, 2783, 2784, 2785, 2786, 2787, 2788, 2789, 2790, 2791, 2792, 2793, 2794, 2795, 2796, 2797, 2798, 2799, 2800, 2801, 2802, 2803, 2804, 2805, 2806, 2807, 2808, 2809, 2810, 2811, 2812, 2813, 2814, 2815, 2816, 2817, 2818, 2819, 2820, 2821, 2822, 2823, 2824, 2825, 2826, 2827, 2828, 2829, 2830, 2831, 2832, 2833, 2834, 2835, 2836, 2837, 2838, 2839, 2840, 2841, 2842, 2843, 2844, 2845, 2846, 2847, 2848, 2849, 2850, 2851, 2852, 2853, 2854, 2855, 2856, 2857, 2858, 2859, 2860, 2861, 2862, 2863, 2864, 2865, 2866, 2867, 2868, 2869, 2870, 2871, 2872, 2873, 2874, 2875, 2876, 2877, 2878, 2879, 2880, 2881, 2882, 2883, 2884, 2885, 2886, 2887, 2888, 2889, 2890, 2891, 2892, 2893, 2894, 2895, 2896, 2897, 2898, 2899, 2900, 2901, 2902, 2903, 2904, 2905, 2906, 2907, 2908, 2909, 2910, 2911, 2912, 2913, 2914, 2915, 2916, 2917, 2918, 2919, 2920, 2921, 2922, 2923, 2924, 2925, 2926, 2927, 2928, 2929, 2930, 2931, 2932, 2933, 2934, 2935, 2936, 2937, 2938, 2939, 2940, 2941, 2942, 2943, 2944, 2945, 2946, 2947, 2948, 2949, 2950, 2951, 2952, 2953, 2954, 2955, 2956, 2957, 2958, 2959, 2960, 2961, 2962, 2963, 2964, 2965, 2966, 2967, 2968, 2969, 2970, 2971, 2972, 2973, 2974, 2975, 2976, 2977, 2978, 2979, 2980, 2981, 2982, 2983, 2984, 2985, 2986, 2987, 2988, 2989, 2990, 2991, 2992, 2993, 2994, 2995, 2996, 2997, 2998, 2999, 3000, 3001, 3002, 3003, 3004, 3005, 3006, 3007, 3008, 3009, 3010, 3011, 3012, 3013, 3014, 3015, 3016, 3017, 3018, 3019, 3020, 3021, 3022, 3023, 3024, 3025, 3026, 3027, 3028, 3029, 3030, 3031, 3032, 3033, 3034, 3035, 3036, 3037, 3038, 3039, 3040, 3041, 3042, 3043, 3044, 3045, 3046, 3047, 3048, 3049, 3050, 3051, 3052, 3053, 3054, 3055, 3056, 3057, 3058, 3059, 3060, 3061, 3062, 3063, 3064, 3065, 3066, 3067, 3068, 3069, 3070, 3071, 3072, 3073, 3074, 3075, 3076, 3077, 3078, 3079, 3080, 3081, 3082, 3083, 3084, 3085, 3086, 3087, 3088, 3089, 3090, 3091, 3092, 3093, 3094, 3095, 3096, 3097, 3098, 3099, 3100, 3101, 3102, 3103, 3104, 3105, 3106, 3107, 3108, 3109, 3110, 3111, 3112, 3113, 3114, 3115, 3116, 3117, 3118, 3119, 3120, 3121, 3122, 3123, 3124, 3125, 3126, 3127, 3128, 3129, 3130, 3131, 3132, 3133, 3134, 3135, 3136, 3137, 3138, 3139, 3140, 3141, 3142, 3143, 3144, 3145, 3146, 3147, 3148, 3149, 3150, 3151, 3152, 3153, 3154, 3155, 3156, 3157, 3158, 3159, 3160, 3161, 3162, 3163, 3164, 3165, 3166, 3167, 3168, 3169, 3170, 3171, 3172, 3173, 3174, 3175, 3176, 3177, 3178, 3179, 3180, 3181, 3182, 3183, 3184, 3185, 3186, 3187, 3188, 3189, 3190, 3191, 3192, 3193, 3194, 3195, 3196, 3197, 3198, 3199, 3200, 3201, 3202, 3203, 3204, 3205, 3206, 3207, 3208, 3209, 3210, 3211, 3212, 3213, 3214, 3215, 3216, 3217, 3218, 3219, 3220, 3221, 3222, 3223, 3224, 3225, 3226, 3227, 3228, 3229, 3230, 3231, 3232, 3233, 3234, 3235, 3236, 3237, 3238, 3239, 3240, 3241, 3242, 3243, 3244, 3245, 3246, 3247, 3248, 3249, 3250, 3251, 3252, 3253, 3254, 3255, 3256, 3257, 3258, 3259, 3260, 3261, 3262, 3263, 3264, 3265, 3266, 3267, 3268, 3269, 3270, 3271, 3272, 3273, 3274, 3275, 3276, 3277, 3278, 3279, 3280, 3281, 3282, 3283, 3284, 3285, 3286, 3287, 3288, 3289, 3290, 3291, 3292, 3293, 3294, 3295, 3296, 3297, 3298, 3299, 3300, 3301, 3302, 3303, 3304, 3305, 3306, 3307, 3308, 3309, 3310, 3311, 3312, 3313, 3314, 3315, 3316, 3317, 3318, 3319, 3320, 3321, 3322, 3323, 3324, 3325, 3326, 3327, 3328, 3329, 3330, 3331, 3332, 3333, 3334, 3335, 3336, 3337, 3338, 3339, 3340, 3341, 3342, 3343, 3344, 3345, 3346, 3347, 3348, 3349, 3350, 3351, 3352, 3353, 3354, 3355, 3356, 3357, 3358, 3359, 3360, 3361, 3362, 3363, 3364, 3365, 3366, 3367, 3368, 3369, 3370, 3371, 3372, 3373, 3374, 3375, 3376, 3377, 3378, 3379, 3380, 3381, 3382, 3383, 3384, 3385, 3386, 3387, 3388, 3389, 3390, 3391, 3392, 3393, 3394, 3395, 3396, 3397, 3398, 3399, 3400, 3401, 3402, 3403, 3404, 3405, 3406, 3407, 3408, 3409, 3410, 3411, 3412, 3413, 3414, 3415, 3416, 3417, 3418, 3419, 3420, 3421, 3422, 3423, 3424, 3425, 3426, 3427, 3428, 3429, 3430, 3431, 3432, 3433, 3434, 3435, 3436, 3437, 3438, 3439, 3440, 3441, 3442, 3443, 3444, 3445, 3446, 3447, 3448, 3449, 3450, 3451, 3452, 3453, 3454, 3455, 3456, 3457, 3458, 3459, 3460, 3461, 3462, 3463, 3464, 3465, 3466, 3467, 3468, 3469, 3470, 3471, 3472, 3473, 3474, 3475, 3476, 3477, 3478, 3479, 3480, 3481, 3482, 3483, 3484, 3485, 3486, 3487, 3488, 3489, 3490, 3491, 3492, 3493, 3494, 3495, 3496, 3497, 3498, 3499, 3500, 3501, 3502, 3503, 3504, 3505, 3506, 3507, 3508, 3509, 3510, 3511, 3512, 3513, 3514, 3515, 3516, 3517, 3518, 3519, 3520, 3521, 3522, 3523, 3524, 3525, 3526, 3527, 3528, 3529, 3530, 3531, 3532, 3533, 3534, 3535, 3536, 3537, 3538, 3539, 3540, 3541, 3542, 3543, 3544, 3545, 3546, 3547, 3548, 3549, 3550, 3551, 3552, 3553, 3554, 3555, 3556, 3557, 3558, 3559, 3560, 3561, 3562, 3563, 3564, 3565, 3566, 3567, 3568, 3569, 3570, 3571, 3572, 3573, 3574, 3575, 3576, 3577, 3578, 3579, 3580, 3581, 3582, 3583, 3584, 3585, 3586, 3587, 3588, 3589, 3590, 3591, 3592, 3593, 3594, 3595, 3596, 3597, 3598, 3599, 3600, 3601, 3602, 3603, 3604, 3605, 3606, 3607, 3608, 3609, 3610, 3611, 3612, 3613, 3614, 3615, 3616, 3617, 3618, 3619, 3620, 3621, 3622, 3623, 3624, 3625, 3626, 3627, 3628, 3629, 3630, 3631, 3632, 3633, 3634, 3635, 3636, 3637, 3638, 3639, 3640, 3641, 3642, 3643, 3644, 3645, 3646, 3647, 3648, 3649, 3650, 3651, 3652, 3653, 3654, 3655, 3656, 3657, 3658, 3659, 3660, 3661, 3662, 3663, 3664, 3665, 3666, 3667, 3668, 3669, 3670, 3671, 3672, 3673, 3674, 3675, 3676, 3677, 3678, 3679, 3680, 3681, 3682, 3683, 3684, 3685, 3686, 3687, 3688, 3689, 3690, 3691, 3692, 3693, 3694, 3695, 3696, 3697, 3698, 3699, 3700, 3701, 3702, 3703, 3704, 3705, 3706, 3707, 3708, 3709, 3710, 3711, 3712, 3713, 3714, 3715, 3716, 3717, 3718, 3719, 3720, 3721, 3722, 3723, 3724, 3725, 3726, 3727, 3728, 3729, 3730, 3731, 3732, 3733, 3734, 3735, 3736, 3737, 3738, 3739, 3740, 3741, 3742, 3743, 3744, 3745, 3746, 3747, 3748, 3749, 3750, 3751, 3752, 3753, 3754, 3755, 3756, 3757, 3758, 3759, 3760, 3761, 3762, 3763, 3764, 3765, 3766, 3767, 3768, 3769, 3770, 3771, 3772, 3773, 3774, 3775, 3776, 3777, 3778, 3779, 3780, 3781, 3782, 3783, 3784, 3785, 3786, 3787, 3788, 3789, 3790, 3791, 3792, 3793, 3794, 3795, 3796, 3797, 3798, 3799, 3800, 3801, 3802, 3803, 3804, 3805, 3806, 3807, 3808, 3809, 3810, 3811, 3812, 3813, 3814, 3815, 3816, 3817, 3818, 3819, 3820, 3821, 3822, 3823, 3824, 3825, 3826, 3827, 3828, 3829, 3830, 3831, 3832, 3833, 3834, 3835, 3836, 3837, 3838, 3839, 3840, 3841, 3842, 3843, 3844, 3845, 3846, 3847, 3848, 3849, 3850, 3851, 3852, 3853, 3854, 3855, 3856, 3857, 3858, 3859, 3860, 3861, 3862, 3863, 3864, 3865, 3866, 3867, 3868, 3869, 3870, 3871, 3872, 3873, 3874, 3875, 3876, 3877, 3878, 3879, 3880, 3881, 3882, 3883, 3884, 3885, 3886, 3887, 3888, 3889, 3890, 3891, 3892, 3893, 3894, 3895, 3896, 3897, 3898, 3899, 3900, 3901, 3902, 3903, 3904, 3905, 3906, 3907, 3908, 3909, 3910, 3911, 3912, 3913, 3914, 3915, 3916, 3917, 3918, 3919, 3920, 3921, 3922, 3923, 3924, 3925, 3926, 3927, 3928, 3929, 3930, 3931, 3932, 3933, 3934, 3935, 3936, 3937, 3938, 3939, 3940, 3941, 3942, 3943, 3944, 3945, 3946, 3947, 3948, 3949, 3950, 3951, 3952, 3953, 3954, 3955, 3956, 3957, 3958, 3959, 3960, 3961, 3962, 3963, 3964, 3965, 3966, 3967, 3968, 3969, 3970, 3971, 3972, 3973, 3974, 3975, 3976, 3977, 3978, 3979, 3980, 3981, 3982, 3983, 3984, 3985, 3986, 3987, 3988, 3989, 3990, 3991, 3992, 3993, 3994, 3995, 3996, 3997, 3998, 3999, 4000, 4001, 4002, 4003, 4004, 4005, 4006, 4007, 4008, 4009, 4010, 4011, 4012, 4013, 4014, 4015, 4016, 4017, 4018, 4019, 4020, 4021, 4022, 4023, 4024, 4025, 4026, 4027, 4028, 4029, 4030, 4031, 4032, 4033, 4034, 4035, 4036, 4037, 4038, 4039, 4040, 4041, 4042, 4043, 4044, 4045, 4046, 4047, 4048, 4049, 4050, 4051, 4052, 4053, 4054, 4055, 4056, 4057, 4058, 4059, 4060, 4061, 4062, 4063, 4064, 4065, 4066, 4067, 4068, 4069, 4070, 4071, 4072, 4073, 4074, 4075, 4076, 4077, 4078, 4079, 4080, 4081, 4082, 4083, 4084, 4085, 4086, 4087, 4088, 4089, 4090, 4091, 4092, 4093, 4094, 4095, 4096, 4097, 4098, 4099, 4100, 4101, 4102, 4103, 4104, 4105, 4106, 4107, 4108, 4109, 4110, 4111, 4112, 4113, 4114, 4115, 4116, 4117, 4118, 4119, 4120, 4121, 4122, 4123, 4124, 4125, 4126, 4127, 4128, 4129, 4130, 4131, 4132, 4133, 4134, 4135, 4136, 4137, 4138, 4139, 4140, 4141, 4142, 4143, 4144, 4145, 4146, 4147, 4148, 4149, 4150, 4151, 4152, 4153, 4154, 4155, 4156, 4157, 4158, 4159, 4160, 4161, 4162, 4163, 4164, 4165, 4166, 4167, 4168, 4169, 4170, 4171, 4172, 4173, 4174, 4175, 4176, 4177, 4178, 4179, 4180, 4181, 4182, 4183, 4184, 4185, 4186, 4187, 4188, 4189, 4190, 4191, 4192, 4193, 4194, 4195, 4196, 4197, 4198, 4199, 4200, 4201, 4202, 4203, 4204, 4205, 4206, 4207, 4208, 4209, 4210, 4211, 4212, 4213, 4214, 4215, 4216, 4217, 4218, 4219, 4220, 4221, 4222, 4223, 4224, 4225, 4226, 4227, 4228, 4229, 4230, 4231, 4232, 4233, 4234, 4235, 4236, 4237, 4238, 4239, 4240, 4241, 4242, 4243, 4244, 4245, 4246, 4247, 4248, 4249, 4250, 4251, 4252, 4253, 4254, 4255, 4256, 4257, 4258, 4259, 4260, 4261, 4262, 4263, 4264, 4265, 4266, 4267, 4268, 4269, 4270, 4271, 4272, 4273, 4274, 4275, 4276, 4277, 4278, 4279, 4280, 4281, 4282, 4283, 4284, 4285, 4286, 4287, 4288, 4289, 4290, 4291, 4292, 4293, 4294, 4295, 4296, 4297, 4298, 4299, 4300, 4301, 4302, 4303, 4304, 4305, 4306, 4307, 4308, 4309, 4310, 4311, 4312, 4313, 4314, 4315, 4316, 4317, 4318, 4319, 4320, 4321, 4322, 4323, 4324, 4325, 4326, 4327, 4328, 4329, 4330, 4331, 4332, 4333, 4334, 4335, 4336, 4337, 4338, 4339, 4340, 4341, 4342, 4343, 4344, 4345, 4346, 4347, 4348, 4349, 4350, 4351, 4352, 4353, 4354, 4355, 4356, 4357, 4358, 4359, 4360, 4361, 4362, 4363, 4364, 4365, 4366, 4367, 4368, 4369, 4370, 4371, 4372, 4373, 4374, 4375, 4376, 4377, 4378, 4379, 4380, 4381, 4382, 4383, 4384, 4385, 4386, 4387, 4388, 4389, 4390, 4391, 4392, 4393, 4394, 4395, 4396, 4397, 4398, 4399, 4400, 4401, 4402, 4403, 4404, 4405, 4406, 4407, 4408, 4409, 4410, 4411, 4412, 4413, 4414, 4415, 4416, 4417, 4418, 4419, 4420, 4421, 4422, 4423, 4424, 4425, 4426, 4427, 4428, 4429, 4430, 4431, 4432, 4433, 4434, 4435, 4436, 4437, 4438, 4439, 4440, 4441, 4442, 4443, 4444, 4445, 4446, 4447, 4448, 4449, 4450, 4451, 4452, 4453, 4454, 4455, 4456, 4457, 4458, 4459, 4460, 4461, 4462, 4463, 4464, 4465, 4466, 4467, 4468, 4469, 4470, 4471, 4472, 4473, 4474, 4475, 4476, 4477, 4478, 4479, 4480, 4481, 4482, 4483, 4484, 4485, 4486, 4487, 4488, 4489, 4490, 4491, 4492, 4493, 4494, 4495, 4496, 4497, 4498, 4499, 4500, 4501, 4502, 4503, 4504, 4505, 4506, 4507, 4508, 4509, 4510, 4511, 4512, 4513, 4514, 4515, 4516, 4517, 4518, 4519, 4520, 4521, 4522, 4523, 4524, 4525, 4526, 4527, 4528, 4529, 4530, 4531, 4532, 4533, 4534, 4535, 4536, 4537, 4538, 4539, 4540, 4541, 4542, 4543, 4544, 4545, 4546, 4547, 4548, 4549, 4550, 4551, 4552, 4553, 4554, 4555, 4556, 4557, 4558, 4559, 4560, 4561, 4562, 4563, 4564, 4565, 4566, 4567, 4568, 4569, 4570, 4571, 4572, 4573, 4574, 4575, 4576, 4577, 4578, 4579, 4580, 4581, 4582, 4583, 4584, 4585, 4586, 4587, 4588, 4589, 4590, 4591, 4592, 4593, 4594, 4595, 4596, 4597, 4598, 4599, 4600, 4601, 4602, 4603, 4604, 4605, 4606, 4607, 4608, 4609, 4610, 4611, 4612, 4613, 4614, 4615, 4616, 4617, 4618, 4619, 4620, 4621, 4622, 4623, 4624, 4625, 4626, 4627, 4628, 4629, 4630, 4631, 4632, 4633, 4634, 4635, 4636, 4637, 4638, 4639, 4640, 4641, 4642, 4643, 4644, 4645, 4646, 4647, 4648, 4649, 4650, 4651, 4652, 4653, 4654, 4655, 4656, 4657, 4658, 4659, 4660, 4661, 4662, 4663, 4664, 4665, 4666, 4667, 4668, 4669, 4670, 4671, 4672, 4673, 4674, 4675, 4676, 4677, 4678, 4679, 4680, 4681, 4682, 4683, 4684, 4685, 4686, 4687, 4688, 4689, 4690, 4691, 4692, 4693, 4694, 4695, 4696, 4697, 4698, 4699, 4700, 4701, 4702, 4703, 4704, 4705, 4706, 4707, 4708, 4709, 4710, 4711, 4712, 4713, 4714, 4715, 4716, 4717, 4718, 4719, 4720, 4721, 4722, 4723, 4724, 4725, 4726, 4727, 4728, 4729, 4730, 4731, 4732, 4733, 4734, 4735, 4736, 4737, 4738, 4739, 4740, 4741, 4742, 4743, 4744, 4745, 4746, 4747, 4748, 4749, 4750, 4751, 4752, 4753, 4754, 4755, 4756, 4757, 4758, 4759, 4760, 4761, 4762, 4763, 4764, 4765, 4766, 4767, 4768, 4769, 4770, 4771, 4772, 4773, 4774, 4775, 4776, 4777, 4778, 4779, 4780, 4781, 4782, 4783, 4784, 4785, 4786, 4787, 4788, 4789, 4790, 4791, 4792, 4793, 4794, 4795, 4796, 4797, 4798, 4799, 4800, 4801, 4802, 4803, 4804, 4805, 4806, 4807, 4808, 4809, 4810, 4811, 4812, 4813, 4814, 4815, 4816, 4817, 4818, 4819, 4820, 4821, 4822, 4823, 4824, 4825, 4826, 4827, 4828, 4829, 4830, 4831, 4832, 4833, 4834, 4835, 4836, 4837, 4838, 4839, 4840, 4841, 4842, 4843, 4844, 4845, 4846, 4847, 4848, 4849, 4850, 4851, 4852, 4853, 4854, 4855, 4856, 4857, 4858, 4859, 4860, 4861, 4862, 4863, 4864, 4865, 4866, 4867, 4868, 4869, 4870, 4871, 4872, 4873, 4874, 4875, 4876, 4877, 4878, 4879, 4880, 4881, 4882, 4883, 4884, 4885, 4886, 4887, 4888, 4889, 4890, 4891, 4892, 4893, 4894, 4895, 4896, 4897, 4898, 4899, 4900, 4901, 4902, 4903, 4904, 4905, 4906, 4907, 4908, 4909, 4910, 4911, 4912, 4913, 4914, 4915, 4916, 4917, 4918, 4919, 4920, 4921, 4922, 4923, 4924, 4925, 4926, 4927, 4928, 4929, 4930, 4931, 4932, 4933, 4934, 4935, 4936, 4937, 4938, 4939, 4940, 4941, 4942, 4943, 4944, 4945, 4946, 4947, 4948, 4949, 4950, 4951, 4952, 4953, 4954, 4955, 4956, 4957, 4958, 4959, 4960, 4961, 4962, 4963, 4964, 4965, 4966, 4967, 4968, 4969, 4970, 4971, 4972, 4973, 4974, 4975, 4976, 4977, 4978, 4979, 4980, 4981, 4982, 4983, 4984, 4985, 4986, 4987, 4988, 4989, 4990, 4991, 4992, 4993, 4994, 4995, 4996, 4997, 4998, 4999, 5000, 5001, 5002, 5003, 5004, 5005, 5006, 5007, 5008, 5009, 5010, 5011, 5012, 5013, 5014, 5015, 5016, 5017, 5018, 5019, 5020, 5021, 5022, 5023, 5024, 5025, 5026, 5027, 5028, 5029, 5030, 5031, 5032, 5033, 5034, 5035, 5036, 5037, 5038, 5039, 5040, 5041, 5042, 5043, 5044, 5045, 5046, 5047, 5048, 5049, 5050, 5051, 5052, 5053, 5054, 5055, 5056, 5057, 5058, 5059, 5060, 5061, 5062, 5063, 5064, 5065, 5066, 5067, 5068, 5069, 5070, 5071, 5072, 5073, 5074, 5075, 5076, 5077, 5078, 5079, 5080, 5081, 5082, 5083, 5084, 5085, 5086, 5087, 5088, 5089, 5090, 5091, 5092, 5093, 5094, 5095, 5096, 5097, 5098, 5099, 5100, 5101, 5102, 5103, 5104, 5105, 5106, 5107, 5108, 5109, 5110, 5111, 5112, 5113, 5114, 5115, 5116, 5117, 5118, 5119, 5120, 5121, 5122, 5123, 5124, 5125, 5126, 5127, 5128, 5129, 5130, 5131, 5132, 5133, 5134, 5135, 5136, 5137, 5138, 5139, 5140, 5141, 5142, 5143, 5144, 5145, 5146, 5147, 5148, 5149, 5150, 5151, 5152, 5153, 5154, 5155, 5156, 5157, 5158, 5159, 5160, 5161, 5162, 5163, 5164, 5165, 5166, 5167, 5168, 5169, 5170, 5171, 5172, 5173, 5174, 5175, 5176, 5177, 5178, 5179, 5180, 5181, 5182, 5183, 5184, 5185, 5186, 5187, 5188, 5189, 5190, 5191, 5192, 5193, 5194, 5195, 5196, 5197, 5198, 5199, 5200, 5201, 5202, 5203, 5204, 5205, 5206, 5207, 5208, 5209, 5210, 5211, 5212, 5213, 5214, 5215, 5216, 5217, 5218, 5219, 5220, 5221, 5222, 5223, 5224, 5225, 5226, 5227, 5228, 5229, 5230, 5231, 5232, 5233, 5234, 5235, 5236, 5237, 5238, 5239, 5240, 5241, 5242, 5243, 5244, 5245, 5246, 5247, 5248, 5249, 5250, 5251, 5252, 5253, 5254, 5255, 5256, 5257, 5258, 5259, 5260, 5261, 5262, 5263, 5264, 5265, 5266, 5267, 5268, 5269, 5270, 5271, 5272, 5273, 5274, 5275, 5276, 5277, 5278, 5279, 5280, 5281, 5282, 5283, 5284, 5285, 5286, 5287, 5288, 5289, 5290, 5291, 5292, 5293, 5294, 5295, 5296, 5297, 5298, 5299, 5300, 5301, 5302, 5303, 5304, 5305, 5306, 5307, 5308, 5309, 5310, 5311, 5312, 5313, 5314, 5315, 5316, 5317, 5318, 5319, 5320, 5321, 5322, 5323, 5324, 5325, 5326, 5327, 5328, 5329, 5330, 5331, 5332, 5333, 5334, 5335, 5336, 5337, 5338, 5339, 5340, 5341, 5342, 5343, 5344, 5345, 5346, 5347, 5348, 5349, 5350, 5351, 5352, 5353, 5354, 5355, 5356, 5357, 5358, 5359, 5360, 5361, 5362, 5363, 5364, 5365, 5366, 5367, 5368, 5369, 5370, 5371, 5372, 5373, 5374, 5375, 5376, 5377, 5378, 5379, 5380, 5381, 5382, 5383, 5384, 5385, 5386, 5387, 5388, 5389, 5390, 5391, 5392, 5393, 5394, 5395, 5396, 5397, 5398, 5399, 5400, 5401, 5402, 5403, 5404, 5405, 5406, 5407, 5408, 5409, 5410, 5411, 5412, 5413, 5414, 5415, 5416, 5417, 5418, 5419, 5420, 5421, 5422, 5423, 5424, 5425, 5426, 5427, 5428, 5429, 5430, 5431, 5432, 5433, 5434, 5435, 5436, 5437, 5438, 5439, 5440, 5441, 5442, 5443, 5444, 5445, 5446, 5447, 5448, 5449, 5450, 5451, 5452, 5453, 5454, 5455, 5456, 5457, 5458, 5459, 5460, 5461, 5462, 5463, 5464, 5465, 5466, 5467, 5468, 5469, 5470, 5471, 5472, 5473, 5474, 5475, 5476, 5477, 5478, 5479, 5480, 5481, 5482, 5483, 5484, 5485, 5486, 5487, 5488, 5489, 5490, 5491, 5492, 5493, 5494, 5495, 5496, 5497, 5498, 5499, 5500, 5501, 5502, 5503, 5504, 5505, 5506, 5507, 5508, 5509, 5510, 5511, 5512, 5513, 5514, 5515, 5516, 5517, 5518, 5519, 5520, 5521, 5522, 5523, 5524, 5525, 5526, 5527, 5528, 5529, 5530, 5531, 5532, 5533, 5534, 5535, 5536, 5537, 5538, 5539, 5540, 5541, 5542, 5543, or 5544 of the peptides shown in any of SEQ ID NOS: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 701, 702, 703, 704, 705, 706, 707, 708, 709, 710, 711, 712, 713, 714, 715, 716, 717, 718, 719, 720, 721, 722, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 847, 848, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 903, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, 950, 951, 952, 953, 954, 955, 956, 957, 958, 959, 960, 961, 962, 963, 964, 965, 966, 967, 968, 969, 970, 971, 972, 973, 974, 975, 976, 977, 978, 979, 980, 981, 982, 983, 984, 985, 986, 987, 988, 989, 990, 991, 992, 993, 994, 995, 996, 997, 998, 999, 1000, 1001, 1002, 1003, 1004, 1005, 1006, 1007, 1008, 1009, 1010, 1011, 1012, 1013, 1014, 1015, 1016, 1017, 1018, 1019, 1020, 1021, 1022, 1023, 1024, 1025, 1026, 1027, 1028, 1029, 1030, 1031, 1032, 1033, 1034, 1035, 1036, 1037, 1038, 1039, 1040, 1041, 1042, 1043, 1044, 1045, 1046, 1047, 1048, 1049, 1050, 1051, 1052, 1053, 1054, 1055, 1056, 1057, 1058, 1059, 1060, 1061, 1062, 1063, 1064, 1065, 1066, 1067, 1068, 1069, 1070, 1071, 1072, 1073, 1074, 1075, 1076, 1077, 1078, 1079, 1080, 1081, 1082, 1083, 1084, 1085, 1086, 1087, 1088, 1089, 1090, 1091, 1092, 1093, 1094, 1095, 1096, 1097, 1098, 1099, 1100, 1101, 1102, 1103, 1104, 1105, 1106, 1107, 1108, 1109, 1110, 1111, 1112, 1113, 1114, 1115, 1116, 1117, 1118, 1119, 1120, 1121, 1122, 1123, 1124, 1125, 1126, 1127, 1128, 1129, 1130, 1131, 1132, 1133, 1134, 1135, 1136, 1137, 1138, 1139, 1140, 1141, 1142, 1143, 1144, 1145, 1146, 1147, 1148, 1149, 1150, 1151, 1152, 1153, 1154, 1155, 1156, 1157, 1158, 1159, 1160, 1161, 1162, 1163, 1164, 1165, 1166, 1167, 1168, 1169, 1170, 1171, 1172, 1173, 1174, 1175, 1176, 1177, 1178, 1179, 1180, 1181, 1182, 1183, 1184, 1185, 1186, 1187, 1188, 1189, 1190, 1191, 1192, 1193, 1194, 1195, 1196, 1197, 1198, 1199, 1200, 1201, 1202, 1203, 1204, 1205, 1206, 1207, 1208, 1209, 1210, 1211, 1212, 1213, 1214, 1215, 1216, 1217, 1218, 1219, 1220, 1221, 1222, 1223, 1224, 1225, 1226, 1227, 1228, 1229, 1230, 1231, 1232, 1233, 1234, 1235, 1236, 1237, 1238, 1239, 1240, 1241, 1242, 1243, 1244, 1245, 1246, 1247, 1248, 1249, 1250, 1251, 1252, 1253, 1254, 1255, 1256, 1257, 1258, 1259, 1260, 1261, 1262, 1263, 1264, 1265, 1266, 1267, 1268, 1269, 1270, 1271, 1272, 1273, 1274, 1275, 1276, 1277, 1278, 1279, 1280, 1281, 1282, 1283, 1284, 1285, 1286, 1287, 1288, 1289, 1290, 1291, 1292, 1293, 1294, 1295, 1296, 1297, 1298, 1299, 1300, 1301, 1302, 1303, 1304, 1305, 1306, 1307, 1308, 1309, 1310, 1311, 1312, 1313, 1314, 1315, 1316, 1317, 1318, 1319, 1320, 1321, 1322, 1323, 1324, 1325, 1326, 1327, 1328, 1329, 1330, 1331, 1332, 1333, 1334, 1335, 1336, 1337, 1338, 1339, 1340, 1341, 1342, 1343, 1344, 1345, 1346, 1347, 1348, 1349, 1350, 1351, 1352, 1353, 1354, 1355, 1356, 1357, 1358, 1359, 1360, 1361, 1362, 1363, 1364, 1365, 1366, 1367, 1368, 1369, 1370, 1371, 1372, 1373, 1374, 1375, 1376, 1377, 1378, 1379, 1380, 1381, 1382, 1383, 1384, 1385, 1386, 1387, 1388, 1389, 1390, 1391, 1392, 1393, 1394, 1395, 1396, 1397, 1398, 1399, 1400, 1401, 1402, 1403, 1404, 1405, 1406, 1407, 1408, 1409, 1410, 1411, 1412, 1413, 1414, 1415, 1416, 1417, 1418, 1419, 1420, 1421, 1422, 1423, 1424, 1425, 1426, 1427, 1428, 1429, 1430, 1431, 1432, 1433, 1434, 1435, 1436, 1437, 1438, 1439, 1440, 1441, 1442, 1443, 1444, 1445, 1446, 1447, 1448, 1449, 1450, 1451, 1452, 1453, 1454, 1455, 1456, 1457, 1458, 1459, 1460, 1461, 1462, 1463, 1464, 1465, 1466, 1467, 1468, 1469, 1470, 1471, 1472, 1473, 1474, 1475, 1476, 1477, 1478, 1479, 1480, 1481, 1482, 1483, 1484, 1485, 1486, 1487, 1488, 1489, 1490, 1491, 1492, 1493, 1494, 1495, 1496, 1497, 1498, 1499, 1500, 1501, 1502, 1503, 1504, 1505, 1506, 1507, 1508, 1509, 1510, 1511, 1512, 1513, 1514, 1515, 1516, 1517, 1518, 1519, 1520, 1521, 1522, 1523, 1524, 1525, 1526, 1527, 1528, 1529, 1530, 1531, 1532, 1533, 1534, 1535, 1536, 1537, 1538, 1539, 1540, 1541, 1542, 1543, 1544, 1545, 1546, 1547, 1548, 1549, 1550, 1551, 1552, 1553, 1554, 1555, 1556, 1557, 1558, 1559, 1560, 1561, 1562, 1563, 1564, 1565, 1566, 1567, 1568, 1569, 1570, 1571, 1572, 1573, 1574, 1575, 1576, 1577, 1578, 1579, 1580, 1581, 1582, 1583, 1584, 1585, 1586, 1587, 1588, 1589, 1590, 1591, 1592, 1593, 1594, 1595, 1596, 1597, 1598, 1599, 1600, 1601, 1602, 1603, 1604, 1605, 1606, 1607, 1608, 1609, 1610, 1611, 1612, 1613, 1614, 1615, 1616, 1617, 1618, 1619, 1620, 1621, 1622, 1623, 1624, 1625, 1626, 1627, 1628, 1629, 1630, 1631, 1632, 1633, 1634, 1635, 1636, 1637, 1638, 1639, 1640, 1641, 1642, 1643, 1644, 1645, 1646, 1647, 1648, 1649, 1650, 1651, 1652, 1653, 1654, 1655, 1656, 1657, 1658, 1659, 1660, 1661, 1662, 1663, 1664, 1665, 1666, 1667, 1668, 1669, 1670, 1671, 1672, 1673, 1674, 1675, 1676, 1677, 1678, 1679, 1680, 1681, 1682, 1683, 1684, 1685, 1686, 1687, 1688, 1689, 1690, 1691, 1692, 1693, 1694, 1695, 1696, 1697, 1698, 1699, 1700, 1701, 1702, 1703, 1704, 1705, 1706, 1707, 1708, 1709, 1710, 1711, 1712, 1713, 1714, 1715, 1716, 1717, 1718, 1719, 1720, 1721, 1722, 1723, 1724, 1725, 1726, 1727, 1728, 1729, 1730, 1731, 1732, 1733, 1734, 1735, 1736, 1737, 1738, 1739, 1740, 1741, 1742, 1743, 1744, 1745, 1746, 1747, 1748, 1749, 1750, 1751, 1752, 1753, 1754, 1755, 1756, 1757, 1758, 1759, 1760, 1761, 1762, 1763, 1764, 1765, 1766, 1767, 1768, 1769, 1770, 1771, 1772, 1773, 1774, 1775, 1776, 1777, 1778, 1779, 1780, 1781, 1782, 1783, 1784, 1785, 1786, 1787, 1788, 1789, 1790, 1791, 1792, 1793, 1794, 1795, 1796, 1797, 1798, 1799, 1800, 1801, 1802, 1803, 1804, 1805, 1806, 1807, 1808, 1809, 1810, 1811, 1812, 1813, 1814, 1815, 1816, 1817, 1818, 1819, 1820, 1821, 1822, 1823, 1824, 1825, 1826, 1827, 1828, 1829, 1830, 1831, 1832, 1833, 1834, 1835, 1836, 1837, 1838, 1839, 1840, 1841, 1842, 1843, 1844, 1845, 1846, 1847, 1848, 1849, 1850, 1851, 1852, 1853, 1854, 1855, 1856, 1857, 1858, 1859, 1860, 1861, 1862, 1863, 1864, 1865, 1866, 1867, 1868, 1869, 1870, 1871, 1872, 1873, 1874, 1875, 1876, 1877, 1878, 1879, 1880, 1881, 1882, 1883, 1884, 1885, 1886, 1887, 1888, 1889, 1890, 1891, 1892, 1893, 1894, 1895, 1896, 1897, 1898, 1899, 1900, 1901, 1902, 1903, 1904, 1905, 1906, 1907, 1908, 1909, 1910, 1911, 1912, 1913, 1914, 1915, 1916, 1917, 1918, 1919, 1920, 1921, 1922, 1923, 1924, 1925, 1926, 1927, 1928, 1929, 1930, 1931, 1932, 1933, 1934, 1935, 1936, 1937, 1938, 1939, 1940, 1941, 1942, 1943, 1944, 1945, 1946, 1947, 1948, 1949, 1950, 1951, 1952, 1953, 1954, 1955, 1956, 1957, 1958, 1959, 1960, 1961, 1962, 1963, 1964, 1965, 1966, 1967, 1968, 1969, 1970, 1971, 1972, 1973, 1974, 1975, 1976, 1977, 1978, 1979, 1980, 1981, 1982, 1983, 1984, 1985, 1986, 1987, 1988, 1989, 1990, 1991, 1992, 1993, 1994, 1995, 1996, 1997, 1998, 1999, 2000, 2001, 2002, 2003, 2004, 2005, 2006, 2007, 2008, 2009, 2010, 2011, 2012, 2013, 2014, 2015, 2016, 2017, 2018, 2019, 2020, 2021, 2022, 2023, 2024, 2025, 2026, 2027, 2028, 2029, 2030, 2031, 2032, 2033, 2034, 2035, 2036, 2037, 2038, 2039, 2040, 2041, 2042, 2043, 2044, 2045, 2046, 2047, 2048, 2049, 2050, 2051, 2052, 2053, 2054, 2055, 2056, 2057, 2058, 2059, 2060, 2061, 2062, 2063, 2064, 2065, 2066, 2067, 2068, 2069, 2070, 2071, 2072, 2073, 2074, 2075, 2076, 2077, 2078, 2079, 2080, 2081, 2082, 2083, 2084, 2085, 2086, 2087, 2088, 2089, 2090, 2091, 2092, 2093, 2094, 2095, 2096, 2097, 2098, 2099, 2100, 2101, 2102, 2103, 2104, 2105, 2106, 2107, 2108, 2109, 2110, 2111, 2112, 2113, 2114, 2115, 2116, 2117, 2118, 2119, 2120, 2121, 2122, 2123, 2124, 2125, 2126, 2127, 2128, 2129, 2130, 2131, 2132, 2133, 2134, 2135, 2136, 2137, 2138, 2139, 2140, 2141, 2142, 2143, 2144, 2145, 2146, 2147, 2148, 2149, 2150, 2151, 2152, 2153, 2154, 2155, 2156, 2157, 2158, 2159, 2160, 2161, 2162, 2163, 2164, 2165, 2166, 2167, 2168, 2169, 2170, 2171, 2172, 2173, 2174, 2175, 2176, 2177, 2178, 2179, 2180, 2181, 2182, 2183, 2184, 2185, 2186, 2187, 2188, 2189, 2190, 2191, 2192, 2193, 2194, 2195, 2196, 2197, 2198, 2199, 2200, 2201, 2202, 2203, 2204, 2205, 2206, 2207, 2208, 2209, 2210, 2211, 2212, 2213, 2214, 2215, 2216, 2217, 2218, 2219, 2220, 2221, 2222, 2223, 2224, 2225, 2226, 2227, 2228, 2229, 2230, 2231, 2232, 2233, 2234, 2235, 2236, 2237, 2238, 2239, 2240, 2241, 2242, 2243, 2244, 2245, 2246, 2247, 2248, 2249, 2250, 2251, 2252, 2253, 2254, 2255, 2256, 2257, 2258, 2259, 2260, 2261, 2262, 2263, 2264, 2265, 2266, 2267, 2268, 2269, 2270, 2271, 2272, 2273, 2274, 2275, 2276, 2277, 2278, 2279, 2280, 2281, 2282, 2283, 2284, 2285, 2286, 2287, 2288, 2289, 2290, 2291, 2292, 2293, 2294, 2295, 2296, 2297, 2298, 2299, 2300, 2301, 2302, 2303, 2304, 2305, 2306, 2307, 2308, 2309, 2310, 2311, 2312, 2313, 2314, 2315, 2316, 2317, 2318, 2319, 2320, 2321, 2322, 2323, 2324, 2325, 2326, 2327, 2328, 2329, 2330, 2331, 2332, 2333, 2334, 2335, 2336, 2337, 2338, 2339, 2340, 2341, 2342, 2343, 2344, 2345, 2346, 2347, 2348, 2349, 2350, 2351, 2352, 2353, 2354, 2355, 2356, 2357, 2358, 2359, 2360, 2361, 2362, 2363, 2364, 2365, 2366, 2367, 2368, 2369, 2370, 2371, 2372, 2373, 2374, 2375, 2376, 2377, 2378, 2379, 2380, 2381, 2382, 2383, 2384, 2385, 2386, 2387, 2388, 2389, 2390, 2391, 2392, 2393, 2394, 2395, 2396, 2397, 2398, 2399, 2400, 2401, 2402, 2403, 2404, 2405, 2406, 2407, 2408, 2409, 2410, 2411, 2412, 2413, 2414, 2415, 2416, 2417, 2418, 2419, 2420, 2421, 2422, 2423, 2424, 2425, 2426, 2427, 2428, 2429, 2430, 2431, 2432, 2433, 2434, 2435, 2436, 2437, 2438, 2439, 2440, 2441, 2442, 2443, 2444, 2445, 2446, 2447, 2448, 2449, 2450, 2451, 2452, 2453, 2454, 2455, 2456, 2457, 2458, 2459, 2460, 2461, 2462, 2463, 2464, 2465, 2466, 2467, 2468, 2469, 2470, 2471, 2472, 2473, 2474, 2475, 2476, 2477, 2478, 2479, 2480, 2481, 2482, 2483, 2484, 2485, 2486, 2487, 2488, 2489, 2490, 2491, 2492, 2493, 2494, 2495, 2496, 2497, 2498, 2499, 2500, 2501, 2502, 2503, 2504, 2505, 2506, 2507, 2508, 2509, 2510, 2511, 2512, 2513, 2514, 2515, 2516, 2517, 2518, 2519, 2520, 2521, 2522, 2523, 2524, 2525, 2526, 2527, 2528, 2529, 2530, 2531, 2532, 2533, 2534, 2535, 2536, 2537, 2538, 2539, 2540, 2541, 2542, 2543, 2544, 2545, 2546, 2547, 2548, 2549, 2550, 2551, 2552, 2553, 2554, 2555, 2556, 2557, 2558, 2559, 2560, 2561, 2562, 2563, 2564, 2565, 2566, 2567, 2568, 2569, 2570, 2571, 2572, 2573, 2574, 2575, 2576, 2577, 2578, 2579, 2580, 2581, 2582, 2583, 2584, 2585, 2586, 2587, 2588, 2589, 2590, 2591, 2592, 2593, 2594, 2595, 2596, 2597, 2598, 2599, 2600, 2601, 2602, 2603, 2604, 2605, 2606, 2607, 2608, 2609, 2610, 2611, 2612, 2613, 2614, 2615, 2616, 2617, 2618, 2619, 2620, 2621, 2622, 2623, 2624, 2625, 2626, 2627, 2628, 2629, 2630, 2631, 2632, 2633, 2634, 2635, 2636, 2637, 2638, 2639, 2640, 2641, 2642, 2643, 2644, 2645, 2646, 2647, 2648, 2649, 2650, 2651, 2652, 2653, 2654, 2655, 2656, 2657, 2658, 2659, 2660, 2661, 2662, 2663, 2664, 2665, 2666, 2667, 2668, 2669, 2670, 2671, 2672, 2673, 2674, 2675, 2676, 2677, 2678, 2679, 2680, 2681, 2682, 2683, 2684, 2685, 2686, 2687, 2688, 2689, 2690, 2691, 2692, 2693, 2694, 2695, 2696, 2697, 2698, 2699, 2700, 2701, 2702, 2703, 2704, 2705, 2706, 2707, 2708, 2709, 2710, 2711, 2712, 2713, 2714, 2715, 2716, 2717, 2718, 2719, 2720, 2721, 2722, 2723, 2724, 2725, 2726, 2727, 2728, 2729, 2730, 2731, 2732, 2733, 2734, 2735, 2736, 2737, 2738, 2739, 2740, 2741, 2742, 2743, 2744, 2745, 2746, 2747, 2748, 2749, 2750, 2751, 2752, 2753, 2754, 2755, 2756, 2757, 2758, 2759, 2760, 2761, 2762, 2763, 2764, 2765, 2766, 2767, 2768, 2769, 2770, 2771, 2772, 2773, 2774, 2775, 2776, 2777, 2778, 2779, 2780, 2781, 2782, 2783, 2784, 2785, 2786, 2787, 2788, 2789, 2790, 2791, 2792, 2793, 2794, 2795, 2796, 2797, 2798, 2799, 2800, 2801, 2802, 2803, 2804, 2805, 2806, 2807, 2808, 2809, 2810, 2811, 2812, 2813, 2814, 2815, 2816, 2817, 2818, 2819, 2820, 2821, 2822, 2823, 2824, 2825, 2826, 2827, 2828, 2829, 2830, 2831, 2832, 2833, 2834, 2835, 2836, 2837, 2838, 2839, 2840, 2841, 2842, 2843, 2844, 2845, 2846, 2847, 2848, 2849, 2850, 2851, 2852, 2853, 2854, 2855, 2856, 2857, 2858, 2859, 2860, 2861, 2862, 2863, 2864, 2865, 2866, 2867, 2868, 2869, 2870, 2871, 2872, 2873, 2874, 2875, 2876, 2877, 2878, 2879, 2880, 2881, 2882, 2883, 2884, 2885, 2886, 2887, 2888, 2889, 2890, 2891, 2892, 2893, 2894, 2895, 2896, 2897, 2898, 2899, 2900, 2901, 2902, 2903, 2904, 2905, 2906, 2907, 2908, 2909, 2910, 2911, 2912, 2913, 2914, 2915, 2916, 2917, 2918, 2919, 2920, 2921, 2922, 2923, 2924, 2925, 2926, 2927, 2928, 2929, 2930, 2931, 2932, 2933, 2934, 2935, 2936, 2937, 2938, 2939, 2940, 2941, 2942, 2943, 2944, 2945, 2946, 2947, 2948, 2949, 2950, 2951, 2952, 2953, 2954, 2955, 2956, 2957, 2958, 2959, 2960, 2961, 2962, 2963, 2964, 2965, 2966, 2967, 2968, 2969, 2970, 2971, 2972, 2973, 2974, 2975, 2976, 2977, 2978, 2979, 2980, 2981, 2982, 2983, 2984, 2985, 2986, 2987, 2988, 2989, 2990, 2991, 2992, 2993, 2994, 2995, 2996, 2997, 2998, 2999, 3000, 3001, 3002, 3003, 3004, 3005, 3006, 3007, 3008, 3009, 3010, 3011, 3012, 3013, 3014, 3015, 3016, 3017, 3018, 3019, 3020, 3021, 3022, 3023, 3024, 3025, 3026, 3027, 3028, 3029, 3030, 3031, 3032, 3033, 3034, 3035, 3036, 3037, 3038, 3039, 3040, 3041, 3042, 3043, 3044, 3045, 3046, 3047, 3048, 3049, 3050, 3051, 3052, 3053, 3054, 3055, 3056, 3057, 3058, 3059, 3060, 3061, 3062, 3063, 3064, 3065, 3066, 3067, 3068, 3069, 3070, 3071, 3072, 3073, 3074, 3075, 3076, 3077, 3078, 3079, 3080, 3081, 3082, 3083, 3084, 3085, 3086, 3087, 3088, 3089, 3090, 3091, 3092, 3093, 3094, 3095, 3096, 3097, 3098, 3099, 3100, 3101, 3102, 3103, 3104, 3105, 3106, 3107, 3108, 3109, 3110, 3111, 3112, 3113, 3114, 3115, 3116, 3117, 3118, 3119, 3120, 3121, 3122, 3123, 3124, 3125, 3126, 3127, 3128, 3129, 3130, 3131, 3132, 3133, 3134, 3135, 3136, 3137, 3138, 3139, 3140, 3141, 3142, 3143, 3144, 3145, 3146, 3147, 3148, 3149, 3150, 3151, 3152, 3153, 3154, 3155, 3156, 3157, 3158, 3159, 3160, 3161, 3162, 3163, 3164, 3165, 3166, 3167, 3168, 3169, 3170, 3171, 3172, 3173, 3174, 3175, 3176, 3177, 3178, 3179, 3180, 3181, 3182, 3183, 3184, 3185, 3186, 3187, 3188, 3189, 3190, 3191, 3192, 3193, 3194, 3195, 3196, 3197, 3198, 3199, 3200, 3201, 3202, 3203, 3204, 3205, 3206, 3207, 3208, 3209, 3210, 3211, 3212, 3213, 3214, 3215, 3216, 3217, 3218, 3219, 3220, 3221, 3222, 3223, 3224, 3225, 3226, 3227, 3228, 3229, 3230, 3231, 3232, 3233, 3234, 3235, 3236, 3237, 3238, 3239, 3240, 3241, 3242, 3243, 3244, 3245, 3246, 3247, 3248, 3249, 3250, 3251, 3252, 3253, 3254, 3255, 3256, 3257, 3258, 3259, 3260, 3261, 3262, 3263, 3264, 3265, 3266, 3267, 3268, 3269, 3270, 3271, 3272, 3273, 3274, 3275, 3276, 3277, 3278, 3279, 3280, 3281, 3282, 3283, 3284, 3285, 3286, 3287, 3288, 3289, 3290, 3291, 3292, 3293, 3294, 3295, 3296, 3297, 3298, 3299, 3300, 3301, 3302, 3303, 3304, 3305, 3306, 3307, 3308, 3309, 3310, 3311, 3312, 3313, 3314, 3315, 3316, 3317, 3318, 3319, 3320, 3321, 3322, 3323, 3324, 3325, 3326, 3327, 3328, 3329, 3330, 3331, 3332, 3333, 3334, 3335, 3336, 3337, 3338, 3339, 3340, 3341, 3342, 3343, 3344, 3345, 3346, 3347, 3348, 3349, 3350, 3351, 3352, 3353, 3354, 3355, 3356, 3357, 3358, 3359, 3360, 3361, 3362, 3363, 3364, 3365, 3366, 3367, 3368, 3369, 3370, 3371, 3372, 3373, 3374, 3375, 3376, 3377, 3378, 3379, 3380, 3381, 3382, 3383, 3384, 3385, 3386, 3387, 3388, 3389, 3390, 3391, 3392, 3393, 3394, 3395, 3396, 3397, 3398, 3399, 3400, 3401, 3402, 3403, 3404, 3405, 3406, 3407, 3408, 3409, 3410, 3411, 3412, 3413, 3414, 3415, 3416, 3417, 3418, 3419, 3420, 3421, 3422, 3423, 3424, 3425, 3426, 3427, 3428, 3429, 3430, 3431, 3432, 3433, 3434, 3435, 3436, 3437, 3438, 3439, 3440, 3441, 3442, 3443, 3444, 3445, 3446, 3447, 3448, 3449, 3450, 3451, 3452, 3453, 3454, 3455, 3456, 3457, 3458, 3459, 3460, 3461, 3462, 3463, 3464, 3465, 3466, 3467, 3468, 3469, 3470, 3471, 3472, 3473, 3474, 3475, 3476, 3477, 3478, 3479, 3480, 3481, 3482, 3483, 3484, 3485, 3486, 3487, 3488, 3489, 3490, 3491, 3492, 3493, 3494, 3495, 3496, 3497, 3498, 3499, 3500, 3501, 3502, 3503, 3504, 3505, 3506, 3507, 3508, 3509, 3510, 3511, 3512, 3513, 3514, 3515, 3516, 3517, 3518, 3519, 3520, 3521, 3522, 3523, 3524, 3525, 3526, 3527, 3528, 3529, 3530, 3531, 3532, 3533, 3534, 3535, 3536, 3537, 3538, 3539, 3540, 3541, 3542, 3543, 3544, 3545, 3546, 3547, 3548, 3549, 3550, 3551, 3552, 3553, 3554, 3555, 3556, 3557, 3558, 3559, 3560, 3561, 3562, 3563, 3564, 3565, 3566, 3567, 3568, 3569, 3570, 3571, 3572, 3573, 3574, 3575, 3576, 3577, 3578, 3579, 3580, 3581, 3582, 3583, 3584, 3585, 3586, 3587, 3588, 3589, 3590, 3591, 3592, 3593, 3594, 3595, 3596, 3597, 3598, 3599, 3600, 3601, 3602, 3603, 3604, 3605, 3606, 3607, 3608, 3609, 3610, 3611, 3612, 3613, 3614, 3615, 3616, 3617, 3618, 3619, 3620, 3621, 3622, 3623, 3624, 3625, 3626, 3627, 3628, 3629, 3630, 3631, 3632, 3633, 3634, 3635, 3636, 3637, 3638, 3639, 3640, 3641, 3642, 3643, 3644, 3645, 3646, 3647, 3648, 3649, 3650, 3651, 3652, 3653, 3654, 3655, 3656, 3657, 3658, 3659, 3660, 3661, 3662, 3663, 3664, 3665, 3666, 3667, 3668, 3669, 3670, 3671, 3672, 3673, 3674, 3675, 3676, 3677, 3678, 3679, 3680, 3681, 3682, 3683, 3684, 3685, 3686, 3687, 3688, 3689, 3690, 3691, 3692, 3693, 3694, 3695, 3696, 3697, 3698, 3699, 3700, 3701, 3702, 3703, 3704, 3705, 3706, 3707, 3708, 3709, 3710, 3711, 3712, 3713, 3714, 3715, 3716, 3717, 3718, 3719, 3720, 3721, 3722, 3723, 3724, 3725, 3726, 3727, 3728, 3729, 3730, 3731, 3732, 3733, 3734, 3735, 3736, 3737, 3738, 3739, 3740, 3741, 3742, 3743, 3744, 3745, 3746, 3747, 3748, 3749, 3750, 3751, 3752, 3753, 3754, 3755, 3756, 3757, 3758, 3759, 3760, 3761, 3762, 3763, 3764, 3765, 3766, 3767, 3768, 3769, 3770, 3771, 3772, 3773, 3774, 3775, 3776, 3777, 3778, 3779, 3780, 3781, 3782, 3783, 3784, 3785, 3786, 3787, 3788, 3789, 3790, 3791, 3792, 3793, 3794, 3795, 3796, 3797, 3798, 3799, 3800, 3801, 3802, 3803, 3804, 3805, 3806, 3807, 3808, 3809, 3810, 3811, 3812, 3813, 3814, 3815, 3816, 3817, 3818, 3819, 3820, 3821, 3822, 3823, 3824, 3825, 3826, 3827, 3828, 3829, 3830, 3831, 3832, 3833, 3834, 3835, 3836, 3837, 3838, 3839, 3840, 3841, 3842, 3843, 3844, 3845, 3846, 3847, 3848, 3849, 3850, 3851, 3852, 3853, 3854, 3855, 3856, 3857, 3858, 3859, 3860, 3861, 3862, 3863, 3864, 3865, 3866, 3867, 3868, 3869, 3870, 3871, 3872, 3873, 3874, 3875, 3876, 3877, 3878, 3879, 3880, 3881, 3882, 3883, 3884, 3885, 3886, 3887, 3888, 3889, 3890, 3891, 3892, 3893, 3894, 3895, 3896, 3897, 3898, 3899, 3900, 3901, 3902, 3903, 3904, 3905, 3906, 3907, 3908, 3909, 3910, 3911, 3912, 3913, 3914, 3915, 3916, 3917, 3918, 3919, 3920, 3921, 3922, 3923, 3924, 3925, 3926, 3927, 3928, 3929, 3930, 3931, 3932, 3933, 3934, 3935, 3936, 3937, 3938, 3939, 3940, 3941, 3942, 3943, 3944, 3945, 3946, 3947, 3948, 3949, 3950, 3951, 3952, 3953, 3954, 3955, 3956, 3957, 3958, 3959, 3960, 3961, 3962, 3963, 3964, 3965, 3966, 3967, 3968, 3969, 3970, 3971, 3972, 3973, 3974, 3975, 3976, 3977, 3978, 3979, 3980, 3981, 3982, 3983, 3984, 3985, 3986, 3987, 3988, 3989, 3990, 3991, 3992, 3993, 3994, 3995, 3996, 3997, 3998, 3999, 4000, 4001, 4002, 4003, 4004, 4005, 4006, 4007, 4008, 4009, 4010, 4011, 4012, 4013, 4014, 4015, 4016, 4017, 4018, 4019, 4020, 4021, 4022, 4023, 4024, 4025, 4026, 4027, 4028, 4029, 4030, 4031, 4032, 4033, 4034, 4035, 4036, 4037, 4038, 4039, 4040, 4041, 4042, 4043, 4044, 4045, 4046, 4047, 4048, 4049, 4050, 4051, 4052, 4053, 4054, 4055, 4056, 4057, 4058, 4059, 4060, 4061, 4062, 4063, 4064, 4065, 4066, 4067, 4068, 4069, 4070, 4071, 4072, 4073, 4074, 4075, 4076, 4077, 4078, 4079, 4080, 4081, 4082, 4083, 4084, 4085, 4086, 4087, 4088, 4089, 4090, 4091, 4092, 4093, 4094, 4095, 4096, 4097, 4098, 4099, 4100, 4101, 4102, 4103, 4104, 4105, 4106, 4107, 4108, 4109, 4110, 4111, 4112, 4113, 4114, 4115, 4116, 4117, 4118, 4119, 4120, 4121, 4122, 4123, 4124, 4125, 4126, 4127, 4128, 4129, 4130, 4131, 4132, 4133, 4134, 4135, 4136, 4137, 4138, 4139, 4140, 4141, 4142, 4143, 4144, 4145, 4146, 4147, 4148, 4149, 4150, 4151, 4152, 4153, 4154, 4155, 4156, 4157, 4158, 4159, 4160, 4161, 4162, 4163, 4164, 4165, 4166, 4167, 4168, 4169, 4170, 4171, 4172, 4173, 4174, 4175, 4176, 4177, 4178, 4179, 4180, 4181, 4182, 4183, 4184, 4185, 4186, 4187, 4188, 4189, 4190, 4191, 4192, 4193, 4194, 4195, 4196, 4197, 4198, 4199, 4200, 4201, 4202, 4203, 4204, 4205, 4206, 4207, 4208, 4209, 4210, 4211, 4212, 4213, 4214, 4215, 4216, 4217, 4218, 4219, 4220, 4221, 4222, 4223, 4224, 4225, 4226, 4227, 4228, 4229, 4230, 4231, 4232, 4233, 4234, 4235, 4236, 4237, 4238, 4239, 4240, 4241, 4242, 4243, 4244, 4245, 4246, 4247, 4248, 4249, 4250, 4251, 4252, 4253, 4254, 4255, 4256, 4257, 4258, 4259, 4260, 4261, 4262, 4263, 4264, 4265, 4266, 4267, 4268, 4269, 4270, 4271, 4272, 4273, 4274, 4275, 4276, 4277, 4278, 4279, 4280, 4281, 4282, 4283, 4284, 4285, 4286, 4287, 4288, 4289, 4290, 4291, 4292, 4293, 4294, 4295, 4296, 4297, 4298, 4299, 4300, 4301, 4302, 4303, 4304, 4305, 4306, 4307, 4308, 4309, 4310, 4311, 4312, 4313, 4314, 4315, 4316, 4317, 4318, 4319, 4320, 4321, 4322, 4323, 4324, 4325, 4326, 4327, 4328, 4329, 4330, 4331, 4332, 4333, 4334, 4335, 4336, 4337, 4338, 4339, 4340, 4341, 4342, 4343, 4344, 4345, 4346, 4347, 4348, 4349, 4350, 4351, 4352, 4353, 4354, 4355, 4356, 4357, 4358, 4359, 4360, 4361, 4362, 4363, 4364, 4365, 4366, 4367, 4368, 4369, 4370, 4371, 4372, 4373, 4374, 4375, 4376, 4377, 4378, 4379, 4380, 4381, 4382, 4383, 4384, 4385, 4386, 4387, 4388, 4389, 4390, 4391, 4392, 4393, 4394, 4395, 4396, 4397, 4398, 4399, 4400, 4401, 4402, 4403, 4404, 4405, 4406, 4407, 4408, 4409, 4410, 4411, 4412, 4413, 4414, 4415, 4416, 4417, 4418, 4419, 4420, 4421, 4422, 4423, 4424, 4425, 4426, 4427, 4428, 4429, 4430, 4431, 4432, 4433, 4434, 4435, 4436, 4437, 4438, 4439, 4440, 4441, 4442, 4443, 4444, 4445, 4446, 4447, 4448, 4449, 4450, 4451, 4452, 4453, 4454, 4455, 4456, 4457, 4458, 4459, 4460, 4461, 4462, 4463, 4464, 4465, 4466, 4467, 4468, 4469, 4470, 4471, 4472, 4473, 4474, 4475, 4476, 4477, 4478, 4479, 4480, 4481, 4482, 4483, 4484, 4485, 4486, 4487, 4488, 4489, 4490, 4491, 4492, 4493, 4494, 4495, 4496, 4497, 4498, 4499, 4500, 4501, 4502, 4503, 4504, 4505, 4506, 4507, 4508, 4509, 4510, 4511, 4512, 4513, 4514, 4515, 4516, 4517, 4518, 4519, 4520, 4521, 4522, 4523, 4524, 4525, 4526, 4527, 4528, 4529, 4530, 4531, 4532, 4533, 4534, 4535, 4536, 4537, 4538, 4539, 4540, 4541, 4542, 4543, 4544, 4545, 4546, 4547, 4548, 4549, 4550, 4551, 4552, 4553, 4554, 4555, 4556, 4557, 4558, 4559, 4560, 4561, 4562, 4563, 4564, 4565, 4566, 4567, 4568, 4569, 4570, 4571, 4572, 4573, 4574, 4575, 4576, 4577, 4578, 4579, 4580, 4581, 4582, 4583, 4584, 4585, 4586, 4587, 4588, 4589, 4590, 4591, 4592, 4593, 4594, 4595, 4596, 4597, 4598, 4599, 4600, 4601, 4602, 4603, 4604, 4605, 4606, 4607, 4608, 4609, 4610, 4611, 4612, 4613, 4614, 4615, 4616, 4617, 4618, 4619, 4620, 4621, 4622, 4623, 4624, 4625, 4626, 4627, 4628, 4629, 4630, 4631, 4632, 4633, 4634, 4635, 4636, 4637, 4638, 4639, 4640, 4641, 4642, 4643, 4644, 4645, 4646, 4647, 4648, 4649, 4650, 4651, 4652, 4653, 4654, 4655, 4656, 4657, 4658, 4659, 4660, 4661, 4662, 4663, 4664, 4665, 4666, 4667, 4668, 4669, 4670, 4671, 4672, 4673, 4674, 4675, 4676, 4677, 4678, 4679, 4680, 4681, 4682, 4683, 4684, 4685, 4686, 4687, 4688, 4689, 4690, 4691, 4692, 4693, 4694, 4695, 4696, 4697, 4698, 4699, 4700, 4701, 4702, 4703, 4704, 4705, 4706, 4707, 4708, 4709, 4710, 4711, 4712, 4713, 4714, 4715, 4716, 4717, 4718, 4719, 4720, 4721, 4722, 4723, 4724, 4725, 4726, 4727, 4728, 4729, 4730, 4731, 4732, 4733, 4734, 4735, 4736, 4737, 4738, 4739, 4740, 4741, 4742, 4743, 4744, 4745, 4746, 4747, 4748, 4749, 4750, 4751, 4752, 4753, 4754, 4755, 4756, 4757, 4758, 4759, 4760, 4761, 4762, 4763, 4764, 4765, 4766, 4767, 4768, 4769, 4770, 4771, 4772, 4773, 4774, 4775, 4776, 4777, 4778, 4779, 4780, 4781, 4782, 4783, 4784, 4785, 4786, 4787, 4788, 4789, 4790, 4791, 4792, 4793, 4794, 4795, 4796, 4797, 4798, 4799, 4800, 4801, 4802, 4803, 4804, 4805, 4806, 4807, 4808, 4809, 4810, 4811, 4812, 4813, 4814, 4815, 4816, 4817, 4818, 4819, 4820, 4821, 4822, 4823, 4824, 4825, 4826, 4827, 4828, 4829, 4830, 4831, 4832, 4833, 4834, 4835, 4836, 4837, 4838, 4839, 4840, 4841, 4842, 4843, 4844, 4845, 4846, 4847, 4848, 4849, 4850, 4851, 4852, 4853, 4854, 4855, 4856, 4857, 4858, 4859, 4860, 4861, 4862, 4863, 4864, 4865, 4866, 4867, 4868, 4869, 4870, 4871, 4872, 4873, 4874, 4875, 4876, 4877, 4878, 4879, 4880, 4881, 4882, 4883, 4884, 4885, 4886, 4887, 4888, 4889, 4890, 4891, 4892, 4893, 4894, 4895, 4896, 4897, 4898, 4899, 4900, 4901, 4902, 4903, 4904, 4905, 4906, 4907, 4908, 4909, 4910, 4911, 4912, 4913, 4914, 4915, 4916, 4917, 4918, 4919, 4920, 4921, 4922, 4923, 4924, 4925, 4926, 4927, 4928, 4929, 4930, 4931, 4932, 4933, 4934, 4935, 4936, 4937, 4938, 4939, 4940, 4941, 4942, 4943, 4944, 4945, 4946, 4947, 4948, 4949, 4950, 4951, 4952, 4953, 4954, 4955, 4956, 4957, 4958, 4959, 4960, 4961, 4962, 4963, 4964, 4965, 4966, 4967, 4968, 4969, 4970, 4971, 4972, 4973, 4974, 4975, 4976, 4977, 4978, 4979, 4980, 4981, 4982, 4983, 4984, 4985, 4986, 4987, 4988, 4989, 4990, 4991, 4992, 4993, 4994, 4995, 4996, 4997, 4998, 4999, 5000, 5001, 5002, 5003, 5004, 5005, 5006, 5007, 5008, 5009, 5010, 5011, 5012, 5013, 5014, 5015, 5016, 5017, 5018, 5019, 5020, 5021, 5022, 5023, 5024, 5025, 5026, 5027, 5028, 5029, 5030, 5031, 5032, 5033, 5034, 5035, 5036, 5037, 5038, 5039, 5040, 5041, 5042, 5043, 5044, 5045, 5046, 5047, 5048, 5049, 5050, 5051, 5052, 5053, 5054, 5055, 5056, 5057, 5058, 5059, 5060, 5061, 5062, 5063, 5064, 5065, 5066, 5067, 5068, 5069, 5070, 5071, 5072, 5073, 5074, 5075, 5076, 5077, 5078, 5079, 5080, 5081, 5082, 5083, 5084, 5085, 5086, 5087, 5088, 5089, 5090, 5091, 5092, 5093, 5094, 5095, 5096, 5097, 5098, 5099, 5100, 5101, 5102, 5103, 5104, 5105, 5106, 5107, 5108, 5109, 5110, 5111, 5112, 5113, 5114, 5115, 5116, 5117, 5118, 5119, 5120, 5121, 5122, 5123, 5124, 5125, 5126, 5127, 5128, 5129, 5130, 5131, 5132, 5133, 5134, 5135, 5136, 5137, 5138, 5139, 5140, 5141, 5142, 5143, 5144, 5145, 5146, 5147, 5148, 5149, 5150, 5151, 5152, 5153, 5154, 5155, 5156, 5157, 5158, 5159, 5160, 5161, 5162, 5163, 5164, 5165, 5166, 5167, 5168, 5169, 5170, 5171, 5172, 5173, 5174, 5175, 5176, 5177, 5178, 5179, 5180, 5181, 5182, 5183, 5184, 5185, 5186, 5187, 5188, 5189, 5190, 5191, 5192, 5193, 5194, 5195, 5196, 5197, 5198, 5199, 5200, 5201, 5202, 5203, 5204, 5205, 5206, 5207, 5208, 5209, 5210, 5211, 5212, 5213, 5214, 5215, 5216, 5217, 5218, 5219, 5220, 5221, 5222, 5223, 5224, 5225, 5226, 5227, 5228, 5229, 5230, 5231, 5232, 5233, 5234, 5235, 5236, 5237, 5238, 5239, 5240, 5241, 5242, 5243, 5244, 5245, 5246, 5247, 5248, 5249, 5250, 5251, 5252, 5253, 5254, 5255, 5256, 5257, 5258, 5259, 5260, 5261, 5262, 5263, 5264, 5265, 5266, 5267, 5268, 5269, 5270, 5271, 5272, 5273, 5274, 5275, 5276, 5277, 5278, 5279, 5280, 5281, 5282, 5283, 5284, 5285, 5286, 5287, 5288, 5289, 5290, 5291, 5292, 5293, 5294, 5295, 5296, 5297, 5298, 5299, 5300, 5301, 5302, 5303, 5304, 5305, 5306, 5307, 5308, 5309, 5310, 5311, 5312, 5313, 5314, 5315, 5316, 5317, 5318, 5319, 5320, 5321, 5322, 5323, 5324, 5325, 5326, 5327, 5328, 5329, 5330, 5331, 5332, 5333, 5334, 5335, 5336, 5337, 5338, 5339, 5340, 5341, 5342, 5343, 5344, 5345, 5346, 5347, 5348, 5349, 5350, 5351, 5352, 5353, 5354, 5355, 5356, 5357, 5358, 5359, 5360, 5361, 5362, 5363, 5364, 5365, 5366, 5367, 5368, 5369, 5370, 5371, 5372, 5373, 5374, 5375, 5376, 5377, 5378, 5379, 5380, 5381, 5382, 5383, 5384, 5385, 5386, 5387, 5388, 5389, 5390, 5391, 5392, 5393, 5394, 5395, 5396, 5397, 5398, 5399, 5400, 5401, 5402, 5403, 5404, 5405, 5406, 5407, 5408, 5409, 5410, 5411, 5412, 5413, 5414, 5415, 5416, 5417, 5418, 5419, 5420, 5421, 5422, 5423, 5424, 5425, 5426, 5427, 5428, 5429, 5430, 5431, 5432, 5433, 5434, 5435, 5436, 5437, 5438, 5439, 5440, 5441, 5442, 5443, 5444, 5445, 5446, 5447, 5448, 5449, 5450, 5451, 5452, 5453, 5454, 5455, 5456, 5457, 5458, 5459, 5460, 5461, 5462, 5463, 5464, 5465, 5466, 5467, 5468, 5469, 5470, 5471, 5472, 5473, 5474, 5475, 5476, 5477, 5478, 5479, 5480, 5481, 5482, 5483, 5484, 5485, 5486, 5487, 5488, 5489, 5490, 5491, 5492, 5493, 5494, 5495, 5496, 5497, 5498, 5499, 5500, 5501, 5502, 5503, 5504, 5505, 5506, 5507, 5508, 5509, 5510, 5511, 5512, 5513, 5514, 5515, 5516, 5517, 5518, 5519, 5520, 5521, 5522, 5523, 5524, 5525, 5526, 5527, 5528, 5529, 5530, 5531, 5532, 5533, 5534, 5535, 5536, 5537, 5538, 5539, 5540, 5541, 5542, 5543, and 5544.

A. Samples

A biological sample from the subject is assayed for an increase or decrease in expression of liver fibrosis related molecules, such as those listed in any of Tables 1, 2, 3, 5, 6 and 12, as well as any of SEQ ID NOS: 1-5544. Suitable biological samples include those containing DNA or RNA (including cDNA and mRNA) or proteins (including peptide fragments of full-length proteins). Biological samples can be used directly, or filtered, denatured, treated with enzymes, concentrated, diluted, or combinations thereof, before the analysis. In some examples, the sample is depleted of high-abundance proteins.

Exemplary samples include blood or fractions thereof, such as a serum or plasma sample. In some examples, the sample is a liver sample, such as a biopsy or fine needle aspirate sample. In a particular example, the sample is a serum or plasma sample that has been immunodepleted. In another particular example, the sample is a serum or plasma sample without immunodepletion.

B. Nucleic acid Detection

The detection in the biological sample of increased or decreased expression of a plurality of liver fibrosis related nucleic acids (nucleic acid sequences corresponding to the liver fibrosis related proteins), such as those related to the proteins listed in any of Tables 1, 2, 3, 5, 6 and 12, as well as any of SEQ ID NOS: 1-5544 can be achieved by methods known in the art. For example, increased or decreased expression of a liver fibrosis related protein can be detected by measuring the cellular level of mRNA specific for the liver fibrosis related protein. mRNA can be measured using techniques well known in the art, including for instance Northern analysis, RT-PCR and mRNA in situ hybridization. Details of mRNA analysis procedures can be found, for instance, in provided examples and in Sambrook et al. (ed.), *Molecular Cloning: A Laboratory Manual,* 2nd ed., vol. 1-3, Cold Spring Harbor Laboratory Press, Cold Spring Harbor, N.Y., 1989. In addition, genomic DNA and cDNA can be detected using routine methods.

Oligonucleotides specific to liver fibrosis related nucleic acids can be chemically synthesized using commercially available machines. These oligonucleotides can then be labeled, for example with radioactive isotopes (such as $^{32}$P) or with non-radioactive labels such as biotin (Ward and Langer et al., *Proc. Natl. Acad. Sci. USA* 78:6633-57, 1981) or a fluorophore, and hybridized to individual DNA samples immobilized on membranes or other solid supports by dot-blot or transfer from gels after electrophoresis. These specific sequences are visualized, for example by methods such as autoradiography or fluorometric (Landegren et al., Science 242:229-37, 1989) or colorimetric reactions (Gebeyehu et al., *Nucleic Acids Res.* 15:4513-34, 1987), such as SISH or FISH.

Nucleic acid molecules isolated from samples can be amplified using routine methods to form nucleic acid amplification products (amplicons, for example by contacting the sample with appropriate primers). In some examples, the resulting amplicons are detected during amplification. In other examples, the amplicons are detected following an amplification reaction. For example, amplicons can then be contacted with one or more oligonucleotide probes that will hybridize under stringent conditions with a liver fibrosis related nucleic acid. The nucleic acid amplification products which hybridize with the probe are then detected and quantified. The oligonucleotide probes or primers can bind specifically to a nucleic acid molecule that encodes a protein or peptide listed in any of Tables 1, 2, 3, 5, 6 and 12, as well as any of SEQ ID NOS: 1-5544.

The nucleic acid molecules obtained from the subject that are associated with the liver fibrosis related proteins can be applied to a liver fibrosis detection array under suitable hybridization conditions to form a hybridization complex. For example, the array can include oligonucleotide probes that can hybridize to liver fibrosis related nucleic acid molecules in the sample, such as different oligonucleotide probes on different portions of the array. In particular examples, the nucleic acid molecules in the test sample are labeled, thereby permitting their detection upon hybridization to the oligonucleotide probe on the array. In one example, a pre-treatment solution of organic compounds, solutions that include organic compounds, or hot water, can be applied before hybridization (see U.S. Pat. No. 5,985,567, herein incorporated by reference).

Hybridization conditions for a given combination of array and target material can be optimized routinely in an empirical manner close to the $T_m$ of the expected duplexes, thereby maximizing the discriminating power of the method. Identification of the location in the array, such as a cell, in which binding occurs, permits a rapid and accurate identification of sequences associated with liver fibrosis present in the amplified material (see below).

The hybridization conditions are selected to permit discrimination between matched and mismatched oligonucleotides. Hybridization conditions can be chosen to correspond to those known to be suitable in standard procedures for hybridization to filters and then optimized for use with the arrays of the disclosure. For example, conditions suitable for hybridization of one type of target would be adjusted for the use of other targets for the array. In particular, temperature is controlled to substantially eliminate formation of duplexes between sequences other than exactly complementary liver fibrosis related nucleic acids. A variety of known hybridization solvents can be employed, the choice being dependent on considerations known to one of skill in the art (see U.S. Pat. No. 5,981,185).

Once the liver fibrosis related nucleic acid from the subject have been hybridized with the oligonucleotides present in the liver fibrosis detection array, the presence of the hybridization complex can be analyzed, for example by detecting the complexes.

Detecting a hybridized complex in an array of oligonucleotide probes has been previously described (see U.S. Pat. No. 5,985,567). In one example, detection includes detecting one or more labels present on the oligonucleotides, the sequences obtained from the subject, or both. In particular examples, developing includes applying a buffer. In one example, the buffer is or includes sodium saline citrate, sodium saline phosphate, tetramethylammonium chloride, sodium saline citrate in ethylenediaminetetra-acetic, sodium saline citrate in sodium dodecyl sulfate, sodium saline phosphate in ethylenediaminetetra-acetic, sodium saline phosphate in sodium dodecyl sulfate, tetramethylammonium chloride in ethylenediaminetetra-acetic, tetramethylammonium chloride in sodium dodecyl sulfate, or combinations thereof. However, other suitable buffer solutions can be used.

Detection can further include treating the hybridized complex with a conjugating solution to effect conjugation or coupling of the hybridized complex with the detection label, and treating the conjugated, hybridized complex with a detection reagent. In one example, the conjugating solution includes streptavidin alkaline phosphatase, avidin alkaline phosphatase, or horseradish peroxidase. Specific, non-limiting examples of conjugating solutions include streptavidin alkaline phosphatase, avidin alkaline phosphatase, or horseradish peroxidase. The conjugated, hybridized complex can be treated with a detection reagent. In one example, the detection reagent includes enzyme-labeled fluorescence reagents or calorimetric reagents. In one specific non-limiting example, the detection reagent is enzyme-labeled fluorescence reagent (ELF) from Molecular Probes, Inc. (Eugene, Oreg.). The hybridized complex can then be placed on a detection device, such as an ultraviolet (UV) transilluminator (manufactured by UVP, Inc. of Upland, Calif.). The signal is developed and the increased signal intensity can be recorded with a recording device, such as a charge coupled device (CCD) camera (manufactured by Photometrics, Inc. of Tucson, Ariz.). In particular examples, these steps are not performed when fluorophores or radiolabels are used.

In particular examples, the method further includes quantification, for instance by determining the amount of hybridization or amount of amplicons produced following amplification (e.g., using PCR).

C. Protein Detection

Protein expression can be detected using any method known in the art, such as by detecting full-length proteins or portions thereof using antibodies or other specific binding agents such as aptamers or aptazymes, or using other methods such as mass spectrometry. The determination of increased or decreased liver fibrosis related protein levels, in comparison to such expression in a control (such as a subject who does not have liver fibrosis or has non-progressing liver fibrosis), is an alternative or supplemental approach to the direct determination of the expression level of liver fibrosis related nucleic acid sequences by the methods outlined above. The availability of antibodies and aptamers specific to liver fibrosis related protein(s) facilitates the detection and quantification of such protein(s) by one of a number of immunoassay methods that are well known in the art, such as those presented in Harlow and Lane (*Antibodies, A Laboratory Manual*, CSHL, New York, 1988). In addition, if such antibodies are not available, methods of constructing antibodies are routine in the art.

TABLE 7

Exemplary antibodies

| Protein | Source | Catalog Number(s) |
|---|---|---|
| F2 (Prothrombin) | Thermo Fisher Scientific Inc | PA1-74072, PA1-74070, PA1-74127 |
| C4A (Complement 4A) | Thermo Fisher Scientific Inc | PA5-16602, LF-MA0187, LF-MA0188, PA1-27058, PA1-28407 |
| QSOX (Sulfhydrul oxidase 1) | Thermo Fisher Scientific Inc | PA5-21578 |
| ECM1 | Thermo Fisher Scientific Inc | MA5-12004, MA1-19051 |
| LGALS3BP | Biorbyt | orb101823, orb102911 |

Any standard immunoassay format (such as ELISA, Western blot, RIA assay, or lateral flow device) can be used to measure liver fibrosis related protein levels. A comparison to control (e.g., subject who does not have liver fibrosis or who has non-progressing liver fibrosis) and an increase or decrease in liver fibrosis related protein expression levels (such as an increase or decrease in any combination of at least 4, at least 5, at least 6, at least 8, or at least 10 proteins or peptides listed in any of Tables 1, 2, 3, 5, 6 and 12, as well as any of SEQ ID NOS: 1-5544) is indicative of liver fibrosis. Immunohistochemical techniques can also be utilized for protein detection and quantification. For example, a sample can be obtained from a subject, and stained for the presence of a liver fibrosis related protein using the appropriate protein specific binding agents and any standard detection system (such as one that includes a secondary antibody conjugated to horseradish peroxidase). General guidance regarding such techniques can be found in Bancroft and Stevens (Theory and Practice of Histological Techniques, Churchill Livingstone, 1982) and Ausubel et al. (Current Protocols in Molecular Biology, John Wiley & Sons, New York, 1998).

For the purposes of quantifying liver fibrosis related proteins, a biological sample of the subject that includes cellular proteins can be used. Quantification of a liver fibrosis related protein can be achieved by immunoassay and the amount compared to levels of the protein found in cells from a subject who does not have liver fibrosis or has non-progressing liver fibrosis.

In one example, a spectrometric method is utilized to detect or quantify an expression level of a target protein (such as those in any of Tables 1, 2, 3, 5, 6 and 12, as well as any of SEQ ID NOS: 1-5544). Exemplary spectrometric methods include mass spectrometry, nuclear magnetic resonance spectrometry, and combinations thereof. In one example, mass spectrometry is used to detect the presence of a target protein (such as those in any of Tables 1-3, 5-6, 12-24) in a biological sample (see for example, Stemmann et al., *Cell* 107(6):715-26, 2001; Zhukov et al., "From Isolation to Identification: Using Surface Plasmon Resonance-Mass Spectrometry in Proteomics, PharmaGenomics, March/April 2002).

A target protein (such as a liver fibrosis related protein or peptide) also can be detected by mass spectrometry assays coupled to immunaffinity assays, the use of matrix-assisted laser desorption/ionization time-of-flight (MALDI-TOF) mass mapping and liquid chromatography/quadrupole time-of-flight electrospray ionization tandem mass spectrometry (LC/Q-TOF-ESI-MS/MS) sequence tag of proteins separated by two-dimensional polyacrylamide gel electrophoresis (2D-PAGE) (Kiernan et al., *Anal. Biochem.*, 301: 49-56, 2002; Poutanen et al., *Mass Spectrom.*, 15: 1685-1692, 2001).

Quantitative mass spectroscopic methods, such as SELDI, can be used to analyze protein expression in a sample. In one example, surface-enhanced laser desorption-ionization time-of-flight (SELDI-TOF) mass spectrometry is used to detect protein expression, for example by using the ProteinChip™ (Ciphergen Biosystems, Palo Alto, Calif.). An Agilent 6224 TOF Mass Spectrometer, which may be upgraded to a 1.5 meter flight tube providing resolution of ~25,000, can be used to detect protein expression. Similar methods are known in the art (for example see U.S. Pat. No. 5,719,060; U.S. Pat. No. 6,897,072; and U.S. Pat. No. 6,881,586). SELDI is a solid phase method for desorption in which the analyte is presented to the energy stream on a surface that enhances analyte capture or desorption. In one embodiment, mass spectrometry is coupled to ion mobility separation (IMS-MS) and optionally, liquid chromatography, for the detection of protein expression. In an embodiment, a single instrument couples ion mobility separation (IMS-MS) to mass spectrometry for the detection of liver fibrosis related protein expression. In one embodiment, the instrument couples 1-m ion mobility separation (IMS-MS) with a time-of-flight mass spectrometer such as the Agilent 6224 TOF MS which may optionally be upgraded to a 1.5 meter flight tube. In one embodiment, IMS separations that take place on the time scale of tens of milliseconds offer an additional separation stage and a way of reducing the need for extended LC separation times. In an IMS separation, ions subject to an electric field while traveling through a buffer gas separate quickly based on ion shape, e.g. compact species drift faster than those with extended structures [9, 10]. IMS can be coupled between LC and orthogonal acceleration time-of-flight (TOF) MS stages, and by combining the three orthogonal separations into a single LC-IMS-MS instrumentation platform, multidimensional high-resolution nested spectra are produced containing elution times, mass-to-charge ratios (m/z) and IMS drift times for all detectable ions in a sample [11, 12]

In one example, one or more of the liver fibrosis related proteins or peptides listed in any of Tables 1, 2, 3, 5, 6 and 12, as well as any of SEQ ID NOS: 1-5544 are detected using a tandem mass spectrometry technique, for example by spiking one or more stable isotope peptides to be detected (such as one or more of those in Tables 1, 2, 3, 5, 6 and 12, as well as any of SEQ ID NOS: 1-5544) into a test serum or plasma sample and detecting setting parameters for the specific detection and accurate quantification of the desired liver fibrosis related proteins.

Briefly, one version of SELDI uses a chromatographic surface with a chemistry that selectively captures analytes of interest, such as four or more those in any of Tables 1, 2, 3, 5, 6 and 12, as well as any of SEQ ID NOS: 1-5544. Chromatographic surfaces can be composed of hydrophobic, hydrophilic, ion exchange, immobilized metal, or other chemistries. For example, the surface chemistry can include binding functionalities based on oxygen-dependent, carbon-dependent, sulfur-dependent, and/or nitrogen-dependent means of covalent or noncovalent immobilization of analytes. The activated surfaces are used to covalently immobilize specific "bait" molecules such as antibodies, receptors, or oligonucleotides often used for biomolecular interaction studies such as protein-protein and protein-DNA interactions.

The surface chemistry allows the bound analytes to be retained and unbound materials to be washed away. Subsequently, analytes bound to the surface (such as any of those in Tables 1, 2, 3, 5, 6 and 12, as well as any of SEQ ID NOS: 1-5544) can be desorbed and analyzed by any of several means, for example using mass spectrometry. When the analyte is ionized in the process of desorption, such as in laser desorption/ionization mass spectrometry, the detector can be an ion detector. Mass spectrometers generally include means for determining the time-of-flight of desorbed ions. This information is converted to mass. However, one need not determine the mass of desorbed ions to resolve and detect them: the fact that ionized analytes strike the detector at different times provides detection and resolution of them. Alternatively, the analyte can be detectably labeled (for example with a fluorophore or radioactive isotope). In these cases, the detector can be a fluorescence or radioactivity detector. A plurality of detection means can be implemented in series to fully interrogate the analyte components and function associated with retained molecules at each location in the array.

Therefore, in a particular example, the chromatographic surface includes antibodies that specifically bind a target protein (such as one or more of those in any of Tables 1, 2, 3, 5, 6 and 12, as well as any of SEQ ID NOS: 1-5544). In other examples, the chromatographic surface consists essentially of, or consists of, antibodies that specifically bind a target protein (such as those in any of Tables 1, 2, 3, 5, 6 and 12, as well as any of SEQ ID NOS: 1-5544). In some examples, the chromatographic surface includes antibodies that bind other molecules, such as housekeeping proteins.

In another example, antibodies are immobilized onto the surface using a bacterial Fc binding support. The chromatographic surface is incubated with a sample. The antigens present in the sample can recognize the antibodies on the chromatographic surface. The unbound proteins and mass spectrometric interfering compounds are washed away and the proteins that are retained on the chromatographic surface are analyzed and detected by SELDI-TOF. The MS profile from the sample can be then compared using differential protein expression mapping, whereby relative expression levels of proteins at specific molecular weights are compared by a variety of statistical techniques and bioinformatic software systems.

Alternatively, the amount of a target protein (such as a liver fibrosis related protein) can be determined using fluorescent methods. In one embodiment, the activity of a fibrosis related protein is measured using a substrate which may emit fluorescence when cleaved by the fibrosis related protein. Alternatively, the activity of a fibrosis related protein may be measured using a fluorescent substrate whose fluorescence is quenched when cleaved by the fibrosis related protein.

To provide an example of a fluorescent method, Quantum dots (Qdots®) are useful, for example when using immunohistochemistry, flow cytometry, and plate-based assays, and may therefore be used in conjunction with this disclosure. Qdot® nanocrystals have unique optical properties including an extremely bright signal for sensitivity and quantitation; and high photostability for imaging and analysis. A single excitation source is needed, and a growing range of conjugates makes them useful in a wide range of cell-based applications. Qdot® Bioconjugates are characterized by quantum yields comparable to the brightest traditional dyes available. Additionally, these quantum dot-based fluorophores absorb 10-1000 times more light than traditional dyes. The emission from the underlying Qdot® quantum dots is narrow and symmetric, which means overlap with other colors is minimized, resulting in minimal bleed through into adjacent detection channels and attenuated crosstalk, in spite of the fact that many more colors can be used simultaneously. Standard fluorescence microscopes are an inexpensive tool for detecting Qdot® Bioconjugates. Since Qdot® conjugates are virtually photo-stable, time can be taken with the microscope to find regions of interest and adequately focus on the samples. Qdot® conjugates are useful any time bright photo-stable emission is required and are particularly useful in multicolor applications where only one excitation source/filter is available and minimal crosstalk among the colors is required.

For example, Qdot® Fluorescent IHC can be performed with secondary antibodies, where the detection substrates are streptavidin-conjugated Qdots®. Image analysis can be performed by initially capturing image cubes on a spectral imaging camera (Cambridge Research Instruments, Woburn, Mass.). Excitation can be conducted with a UV (mercury) light source. The image cubes can then analyze. Briefly, image cubes can be retrieved in the application and data can be extracted and reported based on the pixel intensities of Qdots® expected to emit at 605 nm and 655 nm.

As an example, fluorescence can be measured with the multispectral imaging system Nuance™ (Cambridge Research & Instrumentation, Woburn, Mass.). As another example, fluorescence can be measured with the spectral imaging system SpectrView™ (Applied Spectral Imaging, Vista, Calif.). Multispectral imaging is a technique in which spectroscopic information at each pixel of an image is gathered and the resulting data analyzed with spectral image-processing software. For example, the Nuance system can take a series of images at different wavelengths that are electronically and continuously selectable and then utilized with an analysis program designed for handling such data. The Nuance system is able to obtain quantitative information from multiple dyes simultaneously, even when the spectra of the dyes are highly overlapping or when they are co-localized, or occurring at the same point in the sample, provided that the spectral curves are different. Many biological materials autofluorescence, or emit lower-energy light when excited by higher-energy light. This signal can result in lower contrast images and data. High-sensitivity cameras without multispectral imaging capability only increase the autofluorescence signal along with the fluorescence signal. Multispectral imaging can unmix, or separate out, autofluorescence from the sample and, thereby, increase the achievable signal-to-noise ratio.

D. Solid Supports or Substrates

The described techniques for detecting liver fibrosis related molecules, including proteins and nucleic acids, may include a solid support or substrate which is insoluble or can be made insoluble by a subsequent reaction. Numerous and varied solid supports are known to those skilled in the art and include, without limitation, nitrocellulose, the walls of wells of a reaction tray, multi-well plates, test tubes, polystyrene beads, magnetic beads, membranes and microparticles (such as latex particles). Any suitable porous material with sufficient porosity to allow access by detector reagents and a suitable surface affinity to immobilize capture reagents (e.g., lectins or antibodies) is contemplated by this term. For example, the porous structure of nitrocellulose has excellent absorption and adsorption qualities for a wide variety of reagents, for instance, capture reagents. Nylon possesses similar characteristics and is also suitable. Microporous structures are useful, as are materials with gel structure in the hydrated state.

Further examples of useful solid supports include: natural polymeric carbohydrates and their synthetically modified, cross-linked or substituted derivatives, such as agar, agarose, cross-linked alginic acid, substituted and cross-linked guar gums, cellulose esters, especially with nitric acid and carboxylic acids, mixed cellulose esters, and cellulose ethers; natural polymers containing nitrogen, such as proteins and derivatives, including cross-linked or modified gelatins; natural hydrocarbon polymers, such as latex and rubber; synthetic polymers which may be prepared with suitably porous structures, such as vinyl polymers, including polyethylene, polypropylene, polystyrene, polyvinylchloride, polyvinylacetate and its partially hydrolyzed derivatives, polyacrylamides, polymethacrylates, copolymers and terpolymers of the above polycondensates, such as polyesters, polyamides, and other polymers, such as polyurethanes or polyepoxides; porous inorganic materials such as sulfates or carbonates of alkaline earth metals and magnesium, including barium sulfate, calcium sulfate, calcium carbonate, silicates of alkali and alkaline earth metals, aluminum and magnesium; and aluminum or silicon oxides or hydrates, such as clays, alumina, talc, kaolin, zeolite, silica gel, or glass (these materials may be used as filters with the above polymeric materials); and mixtures or copolymers of the above classes, such as graft copolymers obtained by initializing polymerization of synthetic polymers on a pre-existing natural polymer.

It is contemplated that porous solid supports, such as nitrocellulose, described herein can be in the form of sheets or strips. The thickness of such sheets or strips may vary within wide limits, for example, from about 0.01 to 0.5 mm, from about 0.02 to 0.45 mm, from about 0.05 to 0.3 mm, from about 0.075 to 0.25 mm, from about 0.1 to 0.2 mm, or from about 0.11 to 0.15 mm. The pore size of such sheets or strips may similarly vary within wide limits, for example from about 0.025 to 15 microns, or more specifically from about 0.1 to 3 microns; however, pore size is not intended to be a limiting factor in selection of the solid support.

The surface of a solid support may be activated by chemical processes that cause covalent linkage of an agent (e.g., a capture reagent, such as an antibody) to the support. However, any other suitable method may be used for immobilizing an agent (e.g., a capture reagent) to a solid support including, without limitation, ionic interactions, hydrophobic interactions, covalent interactions and the like. The particular forces that result in immobilization of an agent on a solid phase are not important for the methods and devices described herein.

A solid phase can be chosen for its intrinsic ability to attract and immobilize an agent, such as a capture reagent (such as an antibody or oligonucleotide probe). Alternatively, the solid phase can possess a factor that has the ability to attract and immobilize an agent, such as a capture reagent. The factor can include a charged substance that is oppositely charged with respect to, for example, the capture reagent itself or to a charged substance conjugated to the capture reagent. In another embodiment, a specific binding member may be immobilized upon the solid phase to immobilize its binding partner (e.g., a capture reagent). In this example, therefore, the specific binding member enables the indirect binding of the capture reagent to a solid phase material.

Except as otherwise physically constrained, a solid support may be used in any suitable shapes, such as films, sheets, strips, or plates, or it may be coated onto or bonded or laminated to appropriate inert carriers, such as paper, glass, plastic films, or fabrics.

E. Lateral Flow Devices

The described techniques for detecting liver fibrosis related molecules, including proteins and nucleic acids, may include use of a lateral flow device. A lateral flow device may be an analytical device in the form of a test strip used in lateral flow chromatography, in which a sample fluid, such as one to be tested for the presence of liver fibrosis related molecules (such as four or more of those shown in any of Tables 1, 2, 3, 5, 6 and 12, as well as any of SEQ ID NOS: 1-5544), flows (for example by capillary action) through the strip (which is frequently made of bibulous materials such as paper, nitrocellulose, and cellulose). The test sample and any suspended target molecule(s) can flow along the strip to a detection zone to indicate a presence, absence and/or quantity of the target molecule(s)

Numerous lateral flow analytical devices are known, and include those shown in U.S. Pat. Nos. 4,313,734; 4,435,504; 4,775,636; 4,703,017; 4,740,468; 4,806,311; 4,806,312; 4,861,711; 4,855,240; 4,857,453; 4,943,522; 4,945,042; 4,496,654; 5,001,049; 5,075,078; 5,126,241; 5,451,504; 5,424,193; 5,712,172; 6,555,390; 6,368,876; 7,799,554; EP 0810436; and WO 92/12428; WO 94/01775; WO 95/16207; and WO 97/06439.

Lateral flow devices can in one example be a one-step lateral flow assay in which a sample fluid is placed in a sample or wicking area on a bibulous strip (though, non-bibulous materials can be used, and rendered bibulous by applying a surfactant to the material), and allowed to migrate along the strip until the sample comes into contact with the detection mechanism. In one embodiment, the sample fluid can flow into an area of the lateral flow device housing oligonucleotide probes for the at least two (e.g., at least 3, at least 4, at least 5 or at least 10) liver fibrosis related nucleic acids. In another embodiment, the sample fluid can flow into an area of the lateral flow device housing antibodies specific for the at least two (e.g., at least 3, at least 4, at least 5 or at least 10) liver fibrosis related proteins and, optionally, labeled secondary antibodies specific for the antibodies which bind to the at least two (e.g., at least 3, at least 4, at least 5 or at least 10) liver fibrosis related proteins.

In some examples, the strip includes multiple regions for detecting different target proteins or other molecules in the sample (for example in parallel lines or as other separate portions of the device). For example, the device can include different regions, each containing antibodies or oligonucleotide probes specific for a different liver fibrosis-related proteins or nucleic acids, respectively. For example, the device can include at least 4, at least 10, at least 20, at least 50, or at least 100 different such regions. The test strips can also incorporate control indicators, which provide a signal that the test has adequately been performed, even if a positive signal indicating the presence (or absence) of a target is not achieved.

A lateral flow device can include a sample application area or wicking pad, which is where the fluid or liquid sample is introduced. In one example, the sample may be introduced to the sample application area by external application, as with a dropper or other applicator. In another example, the sample application area may be directly immersed in the sample, such as when a test strip is dipped into a container holding a sample. In yet another example, the sample may be applied, blotted, poured or expressed onto the sample application area.

A lateral flow device can include a reagent or conjugation pad, the region of a lateral flow device where reagents are immobilized, such as antibodies or aptamers for liver fibrosis-related proteins, which may be immobilized to magnetic beads or other materials. A lateral flow device may have more than one conjugation area, for example, a "primary conjugation area," a "secondary conjugation area," and so on. Often different reagents are immobilized in the primary, secondary, or other conjugation areas. Multiple conjugation areas may have any orientation with respect to each other on the lateral flow substrate; for example, a primary conjugation area may be distal or proximal to a secondary (or other) conjugation area and vice versa. Alternatively, a primary conjugation area and a conjugation (or other) area may be oriented perpendicularly to each other such that the two (or more) conjugation areas form a cross or a plus sign or other symbol. For example, Apilux et al. (*Anal. Chem.* 82:1727-32, 2010), Dungchai et al. (*Anal. Chem.* 81:5821-6, 2009), and Dungchai et al. (*Analytica Chemica Acta* 674:227-33, 2010), provide exemplary lateral flow devices with a central sample area and one or more conjugation areas distal to the sample area, which provide independent test zones where independent reactions can occur (e.g., each test zone has a different reagents for detecting a particular liver fibrosis-related molecule, and can further include one or more reaction pads where reactions can take place (for example interspersed between the reagent pads) and an absorption pad, for example that form a "Y", cloverleaf, or spoke-wheel pattern.

A lateral flow device can include one or more reaction pads, such as a membrane, that can be placed to allow desired reactions to occur, and an absorption pad that draws the sample across the conjugation pad(s) and membrane(s) by capillary action and collects it.

F. ELISA Plates

In the most common type of ELISA, the solid phase is coated with a member of the binding pair. Thus, ELISA plates containing a specific binding agent for each of the at least two liver fibrosis related molecules (e.g., at least 3, at least 4, at least 5 or at least 10) to be detected, each in different wells or different sections of the plate, can be used. For example, the solid phase can be coated with antibodies or aptamers specific for the liver fibrosis-related proteins to be detected, each on a different region of the solid phase. For example, ELISA plates can be coated with a specific antibody (or antigen). The microplate may be incubated for a period of time, during which time the antibodies or aptamers adhere to the walls of the microwells up to the fluid fill level. The microwells are then washed leaving a microplate having microwells whose walls are uniformly covered with antibodies or aptamers up to the fluid fill level. Similarly, the solid phase can be coated with oligonucleotides specific for the liver fibrosis-related nucleic acids to be detected, each on a different region of the solid phase.

In some examples, an aliquot of the sample to be examined is incubated with the solid coated solid phase and any liver fibrosis-related molecule that may be present is captured onto the solid phase. After washing to remove residual sample and any interfering materials it may contain, a second binding agent, specific for the liver fibrosis-related molecule and conjugated to label can be added to the solid phase to permit detection of any liver fibrosis-related molecule that bound to the agents immobilized on the solid phase. Alternatively, the liver fibrosis-related molecules in the sample are labeled prior to applying them to the solid phase, thus permitting their detection upon binding.

It will be realized that the above is a general procedure for bioassay and that many variations are known in the art including fluorogenic and luminogenic substrates for ELISA, direct labeling of the second member of the binding pair with a fluorescent or luminescent molecule and nucleic acids or other specific pairing agents instead of antibodies as the binding agent. Samples may be diluted prior to being dispensed into the solid phase or they may be dispensed into deep well microplates, diluted in situ and then the diluted analyte transferred to the functional solid phase.

The most common type of solid phase is a standard sample vessel known as a microplate which can be stored easily and which may be used with a variety of biological specimens. Microplates are available commercially and are made from e.g., polystyrene, PVC, Perspex or Lucite Known microplates comprise 96 wells (also commonly known as "microwells") which are symmetrically arranged in an 8×12 array. Microwells typically have a maximum volume capacity of approximately 350 µl. However, normally only 10-200 µl of fluid is dispensed into a microwell. In some arrangements of the microplate the microwells are arranged in strips of 8 or 12 wells that can be moved and combined in a carrier to give a complete plate having conventional dimensions. One skilled in the art will appreciate that other arrangements of microplates are known.

Positive and negative controls are generally supplied with commercial kits and are used for quality control and to provide a relative cut-off. After reading the processed microplate, the results of the controls are checked against the manufacturer's validated values to ensure that the analysis has operated correctly and then the value is used to distinguish positive from negative specimens and a cut-off value is calculated. Standards are usually provided for quantitative assays and are used to build a standard curve from which the concentration of analyte in a specimen may be interpolated.

It will be recognized that the ELISA procedure as outlined above involves multiple steps including pipetting, incubation, washing, transferring microplates between activities, reading and data analysis. These steps can be automated.

A laboratory can receive a number of sample tubes containing, for example, body fluid from a number of patients. A specified amount of fluid is then removed from the sample and is then dispensed into one or more microwells of a microplate containing the desired specific binding agents (e.g., antibodies, aptamers, oligonucleotide probes). To detect several different proteins, the sample is dispensed into a number of separate microplates or microwells, each coated with a different binding agent. Alternatively, a single microplate can contain a plurality of wells, each coated with the same specific binding agent (or having a few wells as controls), thus permitting analysis of a plurality of different patient samples. Each microplate or microwell can then be processed to detect the presence of a different liver fibrosis-related molecule. To analyze several different liver fibrosis-related molecules a multiplicity of microplates can be used and transfer of aliquots of the same specimen to the different microplates. Similarly, use of microplates with different binding agents in different microwells permits mutiplexing. For example, a single microwell may be used to determine whether a patient has antibodies to one of the at least two (e.g., at least 3, at least 4, at least 5 or at least 10) liver fibrosis related proteins.

Multiplexing enables multiple different tests to be performed simultaneously upon the same patient sample. One approach to multiplexing is to provide a microplate comprising 96 sample wells wherein an array of different capture antibodies is disposed in each sample well. The arrays comprise, for example, 20 nl spots each having a diameter of 350 µm. The spots are arranged with a pitch spacing of, for example, 650 µm. Each spot may correspond with a different capture antibody. Multiplexing enables a greater number of data points and more information per assay to be obtained compared with conventional ELISA techniques wherein each sample plate tests for a single analyte of interest.

VI. Treatment of Liver Fibrosis and Related Conditions

In certain embodiments, a therapy may be provided based on the diagnosis or prognosis of liver fibrosis or pre-fibrosis. Thus, in some examples the disclosed methods include treating a subject who has been diagnosed or prognosed with liver fibrosis. The disclosed therapeutic agents are administered at therapeutically effective amounts.

Treatment, as used herein, refers to any therapeutic intervention that ameliorates a sign or symptom of a pathological condition, such a sign or symptom of liver fibrosis, or interferes with an underlying pathological process implicated in the condition, such as inflammation in the liver, elevation of liver enzyme levels, and/or the formation of fibrotic structures within the liver. Treatment can also induce remission or cure of a condition, such as liver fibrosis. In particular examples, treatment includes preventing a disease, for example by inhibiting the full development of a disease, such as preventing liver fibrosis or preventing development of a disease or disorder that results from a liver fibrosis. Prevention of a disease does not require a total absence of disease. For example, a decrease of at least 20% or at least 50% can be sufficient.

Treatment of liver fibrosis may be directed toward treatment of liver fibrosis itself and/or treating an underlying cause of liver fibrosis. Recent evidence indicates that even advanced fibrosis is reversible. In experimentally induced fibrosis, cessation of liver injury results in fibrosis regression. In humans, spontaneous resolution of liver fibrosis can occur after successful treatment of the underlying disease. In one example, the antifibrotic therapy administered to the subject is liver-specific, well tolerated when administered for prolonged periods of time, and effective in attenuating excessive collagen deposition without affecting normal ECM synthesis. Exemplary therapies that can be administered in therapeutically effective amounts to a subject diagnosed or prognosed with liver fibrosis are shown in Table 8.

TABLE 8

Exemplary anti-fibrotic drugs for the treatment of liver fibrosis

| Agent | Mode of Administration |
| --- | --- |
| Angiotensin inhibitors | iv, oral |
| Colchicine | Iv, oral |
| Corticosteroids | iv, oral |
| Endothelin inhibitors | iv, oral |
| Interferon-alpha | iv, oral |
| Interleukin-10 | iv |
| Pentoxyfylline | iv, oral |
| Phosphatidylcholine | iv, oral |
| PPAR antagonists | iv, oral |
| S-adenosyl methionine | iv, oral |
| Sho-saiko-to | oral |
| TGF-β1 inhibitors | iv, oral |
| Tocopherol | iv, oral |

In one example, an antiinflammatory drug is used to treat or prevent the liver fibrosis. Corticosteroids can be administered to treat hepatic fibrosis in patients with autoimmune hepatitis and acute alcoholic hepatitis.

Inhibition of the accumulation of activated hepatic stellate cells (HSCs) by modulating either their activation and/or proliferation or promoting their apoptosis is another treatment method. Antioxidants such as vitamin E, silymarin, phosphatidylcholine, and S-adenosyl-L-methionine inhibit HSC activation, protect hepatocytes from undergoing apoptosis, and attenuate experimental liver fibrosis. Antioxidants exert beneficial effects in patients with liver fibrosis patients such as those with alcohol-induced liver disease and NASH. Cell-specific delivery to HSCs can be obtained using different carriers (e.g., cyclic peptides coupled to albumin recognizing collagen type VI receptor and/or PDGFR).

In one example, treatment or prevention of liver fibrosis includes administration of an agent that disrupts TGF-β synthesis and/or signaling pathways. In one example, treatment of prevention of liver fibrosis includes administration of a growth factor (e.g., IGF, hepatocyte growth factor, and cardiotrophin) to attenuate liver fibrosis. Substances that inhibit key signal transduction pathways involved in liver fibrogenesis, such aspentoxifylline (phosphodiesterase inhibitor), amiloride ($Na^+/H^+$ pump inhibitor), and S-farnesylthiosalicylic acid (Ras antagonist), can be used. In addition, ligands of PPARa and/or PPARy such as thiazolindiones can be used to treat liver fibrosis.

In one example, inhibition of the renin-angiotensin system is used to treat liver fibrosis.

The blockade of endothelin-1 type A receptors and the administration of vasodilators (prostaglandin E2 and nitric oxide donors) exert antifibrotic activity. Different herbal compounds, such as Sho-saiko-to, glycyrrhizin, and savia miltiorhiza, have antifibrotic effects. Another approach is the inhibition of collagen production and/or the promotion of its degradation. For example, inhibitors of prolyl-4 hydroxylase and halofuginone can prevent the development of cirrhosis by inhibiting collagen synthesis. MMP-8 and urokinase-type plasminogen activator can also stimulate collagen degradation. In one example, infusion of mesenchymal stem cells ameliorates fibrosis.

Antifibrotic therapy may differ depending on the type of liver disease. In patients with chronic HCV infection, antiviral treatments (e.g., pegylated IFN plus ribavirin) can improve liver fibrosis. Renin-angiotensin system inhibitors can be used for the treatment of liver fibrosis in patients with chronic HCV infection. In some examples, treatment of metabolic syndrome in patients with chronic hepatitis C may also decrease fibrosis progression. In patients with alcohol-induced liver disease, alcohol abstinence may be prescribed for prevention/treatment of liver fibrosis. Antioxidants (e.g., S-adenosyl-L-methionine and phosphatidylcholine) and hepatocyte protectors (e.g., silymarin) slow down the progression of liver fibrosis and can improve survival. In some examples, for example in patients with autoimmune hepatitis, immunosuppressant therapy exerts antifibrotic effects. Ursodeoxycholic acid can be administered to treat or prevent liver fibrosis. In patients with NASH, weight loss and specific treatments of the metabolic syndrome can reduce fibrosis development. Antioxidants and insulin sensitizers (e.g., thiazolindiones) can be used to exert antifibrogenic effects. Use of pluripotential stem cells in hepatic wound healing can be an effective treatment for liver fibrosis.

Autoimmune hepatitis may be treated with immunosuppressive glucocorticoids with or without azathioprine and thus prevent liver fibrosis development in these patients. Budesonide can induce remission of autoimmune hepatitis with fewer adverse effects than, for example, prednisone. Subjects who do not respond to glucocorticoids and azathioprine may be given other immunosuppressives such as mycophenolate, cyclosporin, tacrolimus and methotrexate.

Kits

The present disclosure provides for kits that include reagents that can be used to diagnose or prognose liver fibrosis, for example to determine if a subject has liver fibrosis or has an increased predisposition to developing liver fibrosis. Such kits allow one to determine if a subject has a differential expression in four or more liver fibrosis related molecules, such as any of those listed in Tables 1, 2, 3, 5, 6 and 12, as well as any of SEQ ID NOS: 1-5544. In some examples, the kit includes a lateral flow device or ELSIA plate containing binding agents specific for at least two (e.g., at least 3, at least 4, at least 5 or at least 10) different liver fibrosis-related molecules, such as antibodies, aptamers, or oligonucleotide probes.

In one example the disclosed kits include binding molecules such as oligonucleotide probes, oligonucleotide primers, antibodies, aptamers or aptazymes (or combinations thereof) that selectively hybridize or bind to liver fibrosis-related molecules that are the target of the kit. Such oligonucleotide probes, oligonucleotide primers, antibodies, aptamers or aptazymes can include a detectable label, such as a fluorophore. In addition, the oligonucleotide probes, oligonucleotide primers, antibodies, aptamers or aptazymes can be in separate vials or containers. In some examples, the oligonucleotide probes, oligonucleotide primers, antibodies, aptamers or aptazymes are part of a solid substrate, such as a lateral flow device or ELISA plate.

In one embodiment, the disclosed kits include oligonucleotide probes or primers (such as a pair of primers that permits amplification of a target liver fibrosis related nucleic acid) that can hybridize to at least two (e.g., at least 3, at least 4, at least 5 or at least 10) different liver fibrosis related nucleic acid molecules (such as mRNA or cDNA) under high stringency. In some examples such probes or primers are at least 10 nucleotides in length, such as at least 12, at least 15, at least 20, at least 30, or at least 50 nucleotides in length. In some examples, the kit includes both oligonucleotide primers for amplifying at least two (e.g., at least 3, at least 4, at least 5 or at least 10) different liver fibrosis related nucleic acid molecules, and corresponding oligonucleotide probes to detect the resulting amplicons. The disclosed kits may further include a substrate to which the oligonucleotide probes are attached.

In one embodiment, the disclosed kits include antibodies (or aptamers or aptazymes) that can specifically bind to at least two (e.g., at least 3, at least 4, at least 5 or at least 10) different liver fibrosis-related proteins. Such kits may additionally include labeled secondary antibodies specific for the primary antibodies which bind to one or more of the at least two (e.g., at least 3, at least 4, at least 5 or at least 10) liver fibrosis related proteins. The disclosed kits may further include a substrate to which the antibodies are attached.

In particular examples, the oligonucleotide probes or antibodies are attached to an array, such as a biochip, lateral flow device, or dipstick. Such an array can include other oligonucleotides or antibodies, for example to serve as negative or positive controls. In one example, the kit includes oligonucleotide probes or primers (or antibodies) that recognize any combination of at least two of the proteins or peptides in any of Tables 1, 2, 3, 5, 6 and 12, as well as any of SEQ ID NOS: 1-5544, such as at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 31, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, at least 60, at least 61, at least 62, at least 63, at least 64, at least 65, at least 66, at least 67, at least 68, at least 69, at least 70, at least 71, at least 72, at least 73, at least 74, at least 75, at least 76, at least 77, at least 78, at least 79, at least 80, at least 81, at least 82, at least 83, at least 84, at least 85, at least 86, at least 87, at least 88, at least 89, at least 90, at least 91, at least 92, at least 93, at least 94, at least 95, at least 96, at least 97, at least 98, at least 99, at least 100, at least 101, at least 102, at least 103, at least 104, at least 105, at least 106, at least 107, at least 108, at least 109, at least 110, at least 111, at least 112, at least 113, at least 114, at least 115, at least 116, at least 117, at least 118, at least 119, at least 120, at least 121, at least 122, at least 123, at least 124, at least 125, at least 126, at least 127, at least 128, at least 129, at least 130, at least 131, at least 132, at least 133, at least 134, at least 135, or all 136 of the liver fibrosis related proteins listed in Tables 1. In various examples, the kit includes oligonucleotide probes or primers (or antibodies) that recognize at least two (e.g., at least 3, at least 4, at least 5 or at least 10) proteins or peptides listed in one of Table 2, Table 3, Table 5, or any of SEQ ID NOS: 1-5544.

In another example, the kit includes one or more of:

1) at least two stable isotope labeled liver fibrosis proteins listed in Table 1, such as at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 31, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, at least 60, at least 61, at least 62, at least 63, at least 64, at least 65, at least 66, at least 67, at least 68, at least 69, at least 70, at least 71, at least 72, at least 73, at least 74, at least 75, at least 76, at least 77, at least 78, at least 79, at least 80, at least 81, at least 82, at least 83, at least 84, at least 85, at least 86, at least 87, at least 88, at least 89, at least 90, at least 91, at least 92, at least 93, at least 94, at least 95, at least 96, at least 97, at least 98, at least 99, at least 100, at least 101, at least 102, at least 103, at least 104, at least 105, at least 106, at least 107, at least 108, at least 109, at least 110, at least 111, at least 112, at least 113, at least 114, at least 115, at least 116, at least 117, at least 118, at least 119, at least 120, at least 121, at least 122, at least 123, at least 124, at least 125, at least 126, at least 127, at least 128, at least 129, at least 130, at least 131, at least 132, at least 133, at least 134, at least 135, or all 136 of the stable isotope labeled liver fibrosis related proteins listed in Table 1. In one example, the kit includes at least two (e.g., at least 3, at least 4, at least 5 or at least 10) stable isotope labeled liver fibrosis proteins listed in one of Tables 2, 3, and 5, as well as any of SEQ ID NOS: 1-5544;

2) a suitable HPLC column; and 3) materials for quantifying these peptides using, for example, IMS-MS (see Examples).

Such a kit can be used to detect the at least two (e.g., at least 3, at least 4, at least 5 or at least 10) liver fibrosis related peptides, for example by spiking stable isotope peptides into a test serum or plasma sample and detecting setting parameters for their specific detection and accurate quantification by, for example, using IMS-MS, MRM mass spectrometry or tandem mass spectrometry. The kit can further include one or more of a buffer solution, a conjugating solution for developing the signal of interest, or a detection reagent for detecting the signal of interest, each in separate packaging, such as a container. Kits can include instructions, for instance instructions that provide calibration curves or charts to compare with the determined (such as experimentally measured) values. For example, instructions can permit the tester to determine whether liver fibrosis related protein/peptide expression levels are elevated, reduced, or unchanged in comparison to a control sample. In some examples kits include materials for obtaining a sample, such as vials, cotton swabs, and needles.

In one example, the kits can include a lateral flow device containing antibodies specific for at least two (e.g., at least 3, at least 4, at least 5 or at least 10) different liver fibrosis related-peptides and a carrier means, such as a box, a bag, a satchel, plastic carton (such as molded plastic or other clear packaging), wrapper (such as, a sealed or sealable plastic, paper, or metallic wrapper), or other container. In some examples, kit components will be enclosed in a single packaging unit, such as a box or other container, which packaging unit may have compartments into which one or more components of the kit can be placed. In other examples, a kit includes one or more containers, for instance vials, tubes, and the like that can retain, for example, one or more biological samples to be tested, positive and/or negative control samples or solutions (such as, a positive control sample containing the target agent), diluents (such as, phosphate buffers, or saline buffers), and/or wash solutions (such as Tris buffers, saline buffer, or distilled water).

Such kits can include other components, such as a buffer, a chart for correlating detected liver fibrosis related protein or nucleic acid level and amount of liver fibrosis related molecule present, or combinations thereof.

Other kit embodiments include syringes, finger-prick devices, alcohol swabs, gauze squares, cotton balls, bandages, latex gloves, incubation trays with variable numbers of troughs, adhesive plate sealers, data reporting sheets, which may be useful for handling, collecting and/or processing a biological sample. Kits may also optionally contain implements useful for introducing samples onto a lateral flow device, including, for example, droppers, Dispo-pipettes, capillary tubes, rubber bulbs (e.g., for capillary tubes), and the like. Still other kit embodiments may include disposal means for discarding a used device and/or other items used with the device (such as patient samples, etc.). Such disposal means can include, without limitation, containers that are capable of containing leakage from discarded materials, such as plastic, metal or other impermeable bags, boxes or containers.

In some examples, a kit will include instructions for the use of materials contained therein. The instructions may provide direction on how to apply sample to the components of the kit, the amount of time necessary or advisable to wait for results to develop, and details on how to read and interpret the results of the test. Such instructions may also include standards, such as standard tables, graphs, or pictures for comparison of the results of a test. These standards may optionally include the information necessary to quantify liver fibrosis related molecules.

A kit may further comprise an alarm which indicates the presence of liver fibrosis, wherein the alarm is activated if the at least two (e.g., at least 3, at least 4, at least 5 or at least 10) proteins are detected with elevated amounts relative to control levels such as control levels for a subject without liver fibrosis. In various embodiments, the alarm is activated if at least 70%, 75%, 80%, 85%, 90%, 95% or 100% of the at least two (e.g., at least 3, at least 4, at least 5 or at least 10) proteins have levels of expression that are elevated relative to control levels such as control levels for a subject without liver fibrosis. A kit may further comprise an interface which may be configured to accept input of a criterion for diagnosis or prognosis of liver fibrosis. For example, a user may select the proteins for which differential expression is detected and/or used to determine whether a subject has liver fibrosis. A user can also use the interface to provide criterion for a clinical judgment such as to select what percentage of the at least two (e.g., at least 3, at least 4, at least 5 or at least 10) proteins must have differential expression to allow for a diagnosis or prognosis of liver fibrosis. In one embodiment, the alarm is a visual alarm which may be a written or digital display such as a number, word, symbolic indicator (e.g., +/−, Y, N), or combinations thereof. In an embodiment, the visual or other alarm is integrated into the interface.

EXAMPLES

Example 1

Methods and Materials

This example provides technical details and procedures, including relevant instrument settings and materials, used to obtain the protein expression data from transplant and non-transplant patients discussed in the Examples below.

Identification of Liver Fibrosis-Related Proteins in Liver Transplant Subjects

Liver transplant subjects were categorized as slow-, fast- and non-progressors depending on the rate of fibrosis in the new liver. Each slow and fast progressor had a matched non-progressor subject. Specimen samples were matched for the most important clinical variables known to influence the risk of fibrosis progression associated with recurrent hepatitis C after liver transplantation: donor age and cold ischemia time. These pairs were also matched based on patient sex and age. Matching was also performed to time to biopsy so that there were not discordant times to assessment of the degree of fibrosis, as well as days post-transplant. Patients were excluded from consideration with any known confounders including biliary problems, recurrent CMV infection, and more than one episode of rejection. Although there were minor variations in the doses of immunosuppression each patient received, each patient was part of the same immunosuppression protocol, which included induction therapy, followed by tacrolimus and mycophenelate, with gradual transition to tacrolimus monotherapy after 12 months. No patient received more than one bolus of corticosteroids for treatment of rejection and no patient received monoclonal antibodies (such as OKT3 or ATG) for treatment of rejection.

Comparisons were performed across all slow progressors and fast progressors compared to all their matched controls.

Figure 4A:
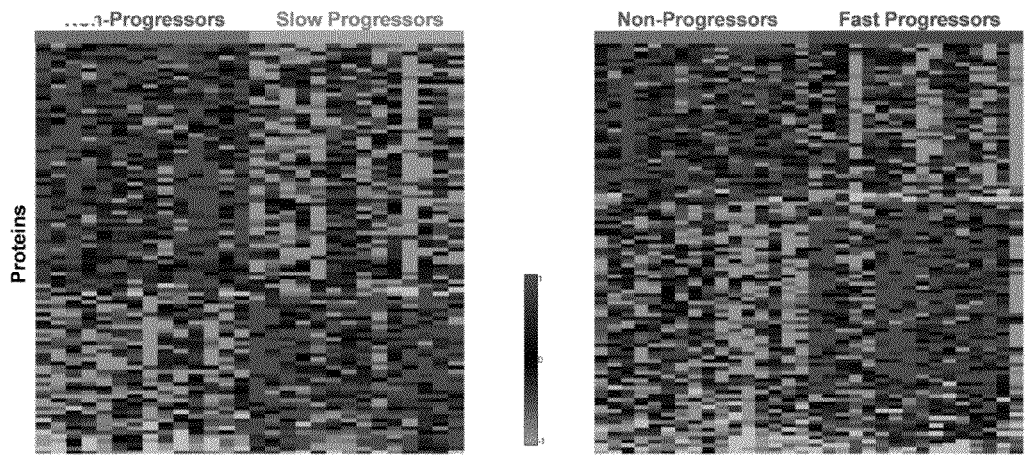
FIG. 4A provides heat maps illustrating the relative log 2 intensity change for proteins with significant differential expression showing up in at least 21 datasets by peptides when non-progressors are compared to either slow progressors (left) or fast progressors (right). Each column represents one of the 60 patients and each row one of the 136 proteins shown in Table 1. Trends between the patient groups are clearly observed, but biodiversity in the human population is also discerned.

Identification and quantification of the detected peptide peaks was performed utilizing the Accurate Mass and Time (AMT) Tag approach (Zimmer et al., *Mass Spectrometry Reviews*, 2006. 25(3):450-482). Briefly, multiple in-house developed/publicly available informatics tools were used to process LC-MS data and correlate the resulting LC-MS features to an AMT tag database containing accurate mass and LC separation elution time information for peptide tags generated from tandem MS Thermo LTQ Orbitrap Velos analyses of human plasma proteins. The AMT tag database only contained peptides which passed a MS-GF cutoff of $1 \times 10^{-9}$ (Sangtae, et al., *J. Proteome Res.*, 7 (8), 3354-3363, 2008). Among the tools used were algorithms for peak-picking and for determining isotopic distributions and charge states (Jaitly et al., *BMC Bioinformatics*, 2009. 10(1):87). Further downstream data analysis incorporated all of the possible detected peptides into a visualization program VIPER (Monroe, *Bioinformatics*, 2007. 23(15):2021-3) to correlate LC-MS features to the peptide identifications in the AMT tag database. The Viper results were matched and refined to give a median mass tolerance of ±2.05 ppm and a median normalized elution tolerance (NET) of ±0.75%. VIPER provided an intensity report for all detected features, normalized LC elution times via alignment to the database, and feature identification. A representative protein was chosen for redundant peptides (see SEQ ID NOS: 1-2633). If a protein was identified with only one significant non-unique peptide it was removed. In DAnTE software, peptide peak intensity values were converted to a log 2 scale statistically compared utilizing ANOVA (performed as a t-test with only two data types in each comparisons) (Polpitiya et al., *Bioinformatics*, 2008. 24(13):1556-8). The analysis only focused on significantly changing peptides (p-values and q-values <0.05). The q-value of a test measures the proportion of false positives incurred (called the false discovery rate) when that particular test is called significant. Significantly changing peptides were assessed at a protein level using DAnTE's Rollup parameters (reference peptide based scaling, where peptides were excluded from scaling if they were not seen in at least 3 datasets and no minimum peptide presence was required). Statistically comparisons were also done at the protein level. Only significantly changing proteins were retained, i.e. some peptides were significant but they were in opposing directions, so the proteins were not significant when the peptides were rolled up (these opposing peptides have grey colored cells in the peptide tables). The three instrument analyses for each same sample were averaged together to create the heatmaps depicted in FIGS. 4A and 4B. FIG. 4A contains all proteins that had at least 21 datapoints and ≥2 peptides. All 136 significantly changing proteins identified by at least two peptides are listed in Table 1 where 34 proteins increased in the slow progressors (SP) and fast progressors (FP) compared to their matched controls, 37 proteins decreased in the SP and FP compared to their matched controls, 5 proteins only increased in the SP compared to their matched controls, 30 proteins only increased in the FP, 19 proteins only decreased in the SP, 5 proteins only decreased in the FP and 6 proteins increased in the FP and decreased in the SP.

A summary is provided in Table 4 above.

Identification of Liver Fibrosis-Related Proteins in Non-Transplant Subjects

In this study liver transplant patients were categorized by fibrosis level.

Identification and quantification of the detected peptide peaks was performed utilizing the Accurate Mass and Time (AMT) Tag approach (Zimmer et al., *Mass Spectrometry Reviews*, 2006. 25(3):450-482). Briefly, multiple in-house developed/publicly available informatics tools were used to process LC-MS data and correlate the resulting LC-MS features to an AMT tag database containing accurate mass and LC separation elution time information for peptide tags generated from tandem MS Thermo LTQ Orbitrap Velos analyses of human plasma proteins. The AMT tag database only contained peptides which passed a MS-GF cutoff of $1 \times 10^{-9}$ (Sangtae, et al., *J. Proteome Res.*, 7 (8), 3354-3363, 2008). Among the tools used were algorithms for peak-picking and for determining isotopic distributions and charge states (Jaitly et al., *BMC Bioinformatics*, 2009. 10(1):87). Further downstream data analysis incorporated all of the possible detected peptides into a visualization program VIPER (Monroe, *Bioinformatics*, 2007. 23(15):2021-3) to correlate LC-MS features to the peptide identifications in the AMT tag database.

Detected peptides are shown in SEQ ID NOS: 2634-5544. Significant proteins had to have ≥2 unique peptides to be used for rollup, 78 proteins passed the criteria (these values were used to create the heatmap in FIG. 5). Table 12 contains the 78 significantly changing proteins and denotes if they were also observed to be differentially expressed in the transplant model data.

Sample Preparation for Liver Fibrosis Samples

Human Serum Samples. Initial blood serum samples were chosen from 60 HCV+ patients following liver transplantation. Additional 60 non-transplant blood serum samples were obtained from HCV+ patients through the Alaska Native Tribal Health Consortium (ANTHC). Non-transplant ANTHC samples were selected based upon biopsy phase (non-fibrosis, 0-1 Ishak score, versus extensive fibrosis/ bridging, 4-6 Ishak score), and availability and condition of serum specimen (non-thawed specimen within 6 months of a diagnostic biopsy). All subjects were recruited and samples were collected under institutional review board-approved protocols.

Serum Depletion and Protein Digestion. Individual human serum samples were partitioned and depleted of 14 highly abundant proteins using a ProteomeLab™ 12.7×79.0-mm IgY14 LC10 affinity LC column (Beckman Coulter, Fullerton, Calif.). The unbound, flow-through fraction containing low- and medium-abundance proteins was collected, directly concentrated in urea buffer (8M urea, 10 mM Tris-HCl, pH 7.4, 150 mM NaCl) by filter centrifugation, then denatured for 1 hour at 37° C. All processing steps following depletion were carried out in a 96-well plate to minimize batch effects associated with processing, utilizing automated protocols on a Biomek FX liquid handling robot (Beckman Coulter). 100 μL aliquots of depleted, concentrated plasma were taken for digestion, giving a starting amount of approximately 100 μg total protein. Aliquots were transferred to a 96-well plate preloaded with urea to give a concentration of 8M. Dithiothreitol (DTT) was then added to a final concentration of 10 μM. Samples were incubated for 1 h at 37° C. to denature and reduce. Samples were then diluted 5-fold with 50 mM ammonium bicarbonate prior to the addition of sequence grade trypsin (Promega) in a 1:50 enzyme to protein ratio. Enzymatic digestion was carried out for 6 h at 37° C. Peptides were desalted using an automated protocol utilizing $C_{18}$ SPEC tips (Varian). Peptides were eluted in 200 μl 80% ACN/0.1% TFA and lyophilized. Desalted peptides were rehydrated in 25 mM Ammonium bicarbonate and concentrations were determined by BCA assay. Final peptide concentrations were normalized to a final concentration of 0.3 μg/μL prior to storage at −80° C. until LC-MS analysis.

Sample Preparation for Spiked Serum Sample

Eight non-plasma peptides (Table 9) from Sigma-Aldrich were used without further purification. A final concentration of 0.25 mg/mL was desired for the tryptically-digested human serum sample to avoid undesirable clogging effects. The serum sample was diluted to 1 mg/mL with water and the 8 non-plasma peptides were added to specific final concentrations from 100 pg/mL to 100 ng/mL (noted in Table 9). An additional standard sample consisting of the eight peptides spiked into water at the same concentrations as in the serum sample was prepared to determine the elution times of the spiked peptides and to compare the dynamic range of detection with the serum sample.

TABLE 9

Non-serum peptides spiked into human serum

| Spiking Level | Peptide |
|---|---|
| 100 pg/mL | Melittin, Dynorphin A Porcine Fragment 1-13 |
| 1 ng/mL | Des Pro Ala Bradykinin, Leucine Enkephalin |
| 10 ng/mL | 3X FLAG Peptide, Substance P |
| 100 ng/mL | Methionine Enkephalin, [D-Ala2]-Deltorphin II |

Instrumental Analysis

Analysis of the 120 human serum samples was performed on an in-house built instrument that couples a 1-m ion mobility separation (IMS-MS) with an Agilent 6224 TOF MS upgraded to a 1.5 meter flight tube providing resolution of 25,000 [42]. The analysis of the spiked peptide samples and a small subset of the human serum samples was performed on both a Thermo Fisher Scientific LTQ Orbitrap Velos MS (Velos) (San Jose, Calif., USA) operated in tandem MS (MS/MS) mode and the in-house built IMS-MS instrument. A fully automated in-house built 4-column HPLC system equipped with in-house packed capillary columns was used for both instruments with mobile phase A consisting of 0.1% formic acid in water and phase B comprised of 0.1% formic acid in acetonitrile [43]. A 100-min LC gradient was performed on the Velos MS (using 60 cm long columns with an o.d. of 360 μm, i.d. of 75 μm, and 3-μm $C_{18}$ packing material), while only a 60-min gradient with shorter columns (30 cm long with same dimensions and packing) was used with the IMS-MS. Both gradients linearly increased mobile phase B from 0 to 60% until the final 2-min of the run when B was purged at 95%. 5 μL of each sample was injected for both analyses and the HPLC was operated under a constant flow rate of 0.4 μL/min for the 100-min gradient and 1 μL/min for the 60-min gradient. The Velos MS data were collected from 400-2000 m/z at a resolution of 60,000 (automatic gain control (AGC) target: $1 \times 10^6$) followed by data dependent ion trap MS/MS spectra (AGC target: $1 \times 10^4$) of the ten most abundant ions using a collision energy setting of 35%. A dynamic exclusion time of 60 sec was used to discriminate against previously analyzed ions. IMS-MS data were collected from 100-3200 m/z.

Informatics Approach and Statistical Analysis

Identification and quantification of the detected peptide peaks were performed utilizing the Accurate Mass and Time (AMT) tag approach (Zimmer et al., *Mass Spectrom Rev*, 2006. 25(3):450-82). Briefly, Velos MS/MS data were searched by SEQUEST (Thermo Scientific), and the resulting 13,448 peptides which had a MS-GF score greater than or equal to 1E-9 were used to populate an AMT tag database (Eng et al., *J. Am. Soc. Mass Spec.*, 1994. 5(11):976-989; Kim et al., *J Proteome Res*, 2008. 7(8):3354-63). Multiple in-house developed informatics tools (publicly available ncrr.pnnl.gov/software) were used to process the LC-MS data and correlate the resulting LC-MS features to this AMT tag database that contained accurate mass and LC separation elution time information for peptide tags generated from serum proteins. Among the tools used were algorithms for peak-picking and for determining isotopic distributions and charge states (Jaitly et al., *BMC Bioinformatics*, 2009. 10(1):87). Further downstream data analysis incorporated all possible detected peptides into a visualization program, VIPER, to correlate LC-MS features to the peptide identifications in the AMT tag database (Monroe et al., *Bioinformatics*, 2007. 23(15):2021-3). VIPER provided an intensity report for all detected features, normalized LC elution times via alignment to the database, and featured identification.

For the initial transplant data, a representative protein was chosen for redundant peptides. If a protein was identified with only one significant non-unique peptide it was removed. In DAnTE software, peptide peak intensity values were converted to a log 2 scale statistically compared utilizing ANOVA (performed as a t-test with only two data types in each comparison) (Polpitiya et al., *Bioinformatics*, 2008. 24(13):1556-8). The analysis only focused on significantly changing peptides (p-values and q-values <0.05). The q-value of a test measures the proportion of false positives incurred (called the false discovery rate) when that particular test is called significant. Significantly changing peptides were assessed at a protein level using DAnTE's Rollup parameters (reference peptide based scaling, where peptides were excluded from scaling if they were not seen in at least 3 datasets and no minimum peptide presence was required). Statistically comparisons were also done at the protein level. Only significantly changing proteins were retained (some peptides were significant but they were in opposing directions, so the proteins were not significant when the peptides were rolled up). Final significant proteins identified required at least two significant peptide identifications.

Figure 7:
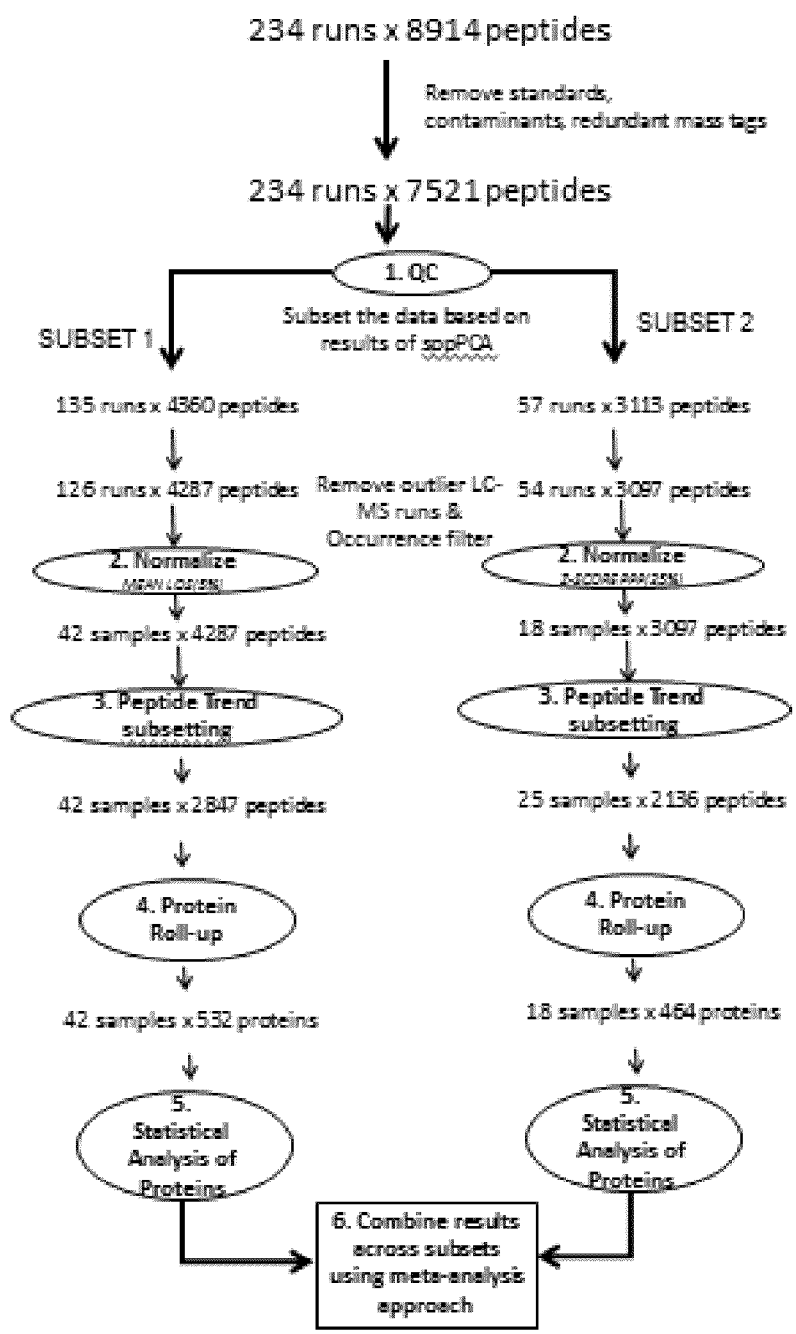
FIG. 7 is a schematic drawing showing the statistical processing pipeline for the verification non-transplant generated data.
Figure 8:
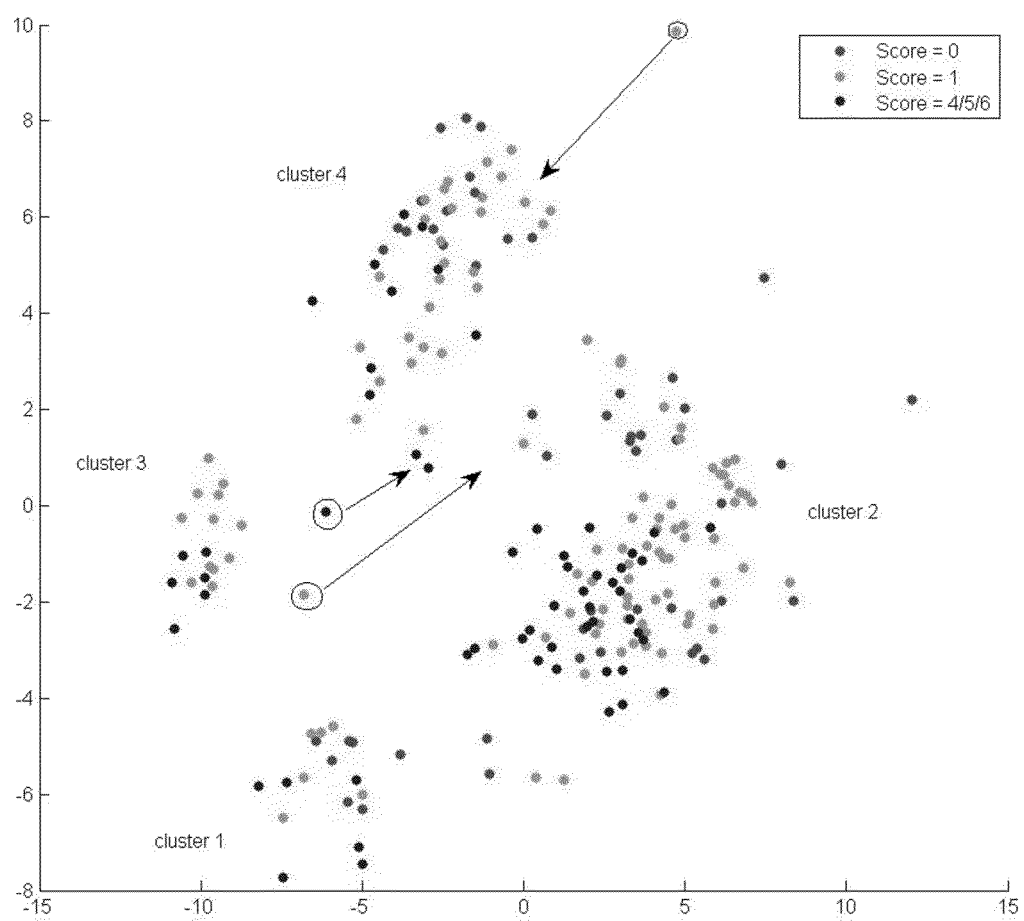
FIG. 8 is a scores plot of the raw peptide abundance values. A sppPCA analysis results in four distinct clusters of data based upon sample preparation and instrument analysis batching. Clusters 4 and 2 were used for further statistical analysis.
Figure 9A:
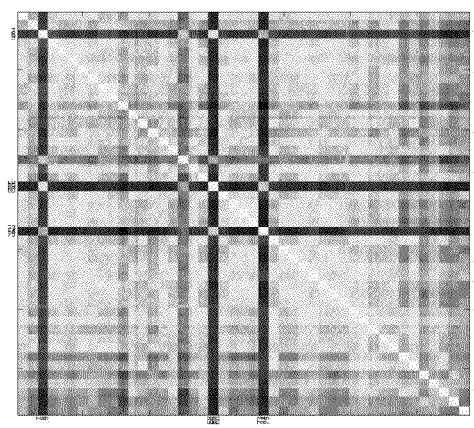
FIGS. 9A-9D show quality control processing diagnostic figures. (A), (C) The correlation coefficient of $\log_{10}$ peptide abundance values across LC-MS analyses. (B), (D) The statistical analysis of the $\log_2$ robust Mahalanobis distances (rMd) to determine if an LC-MS run should be removed from the dataset. The red horizontal line represents a critical value associated with a significance level of 0.0001. Blue downward triangles represent single technical replicates and red triangles, if present, are for replicates where all associated technical replicates are above the line.
Figure 9B:
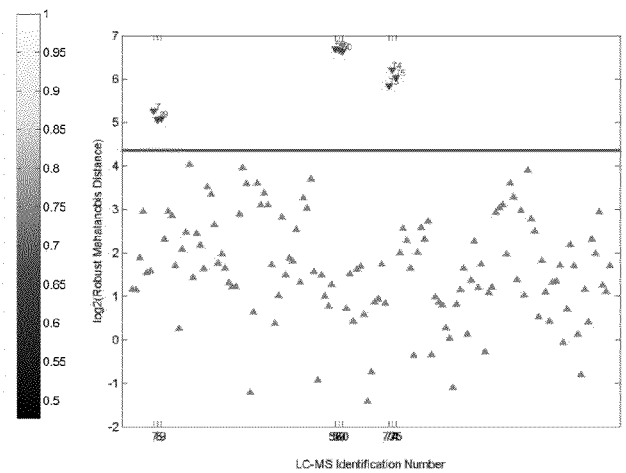
Figure 9C:
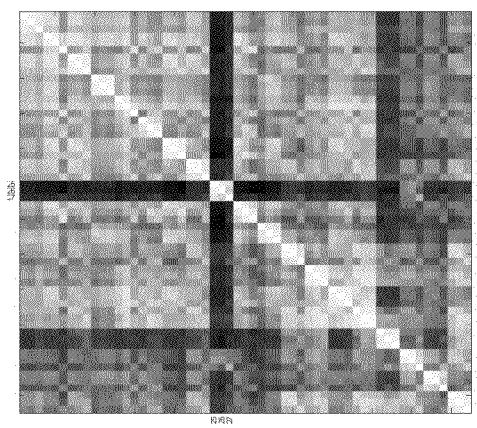
Figure 9D:
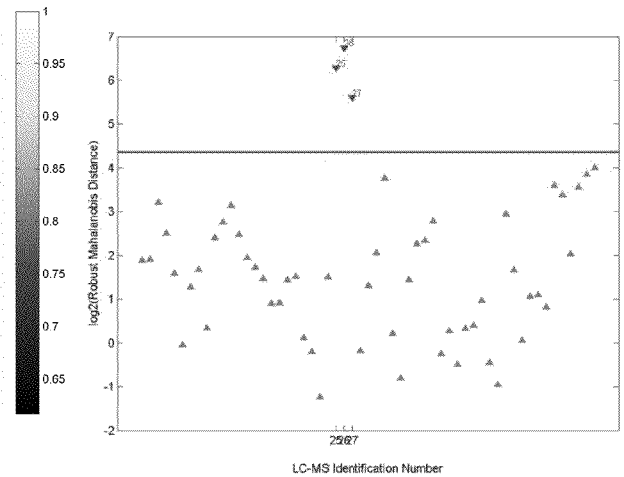

For the verification non-transplant generated data, the final quantitative peptide identifications were independently processed through a series of steps including quality control, normalization, protein quantification, and comparative statistical analyses (FIG. 7). Peptide abundances were transformed to the $\log_{10}$ scale, and fibrosis severity categories were defined as fibrosis score=0; fibrosis score=1; and, fibrosis score=4, 5 or 6. Quality control processing was performed as previously described (Webb-Robertson et al., *J Proteome Res*, 2010. 9(11):5748-56; Matzke et al., *Bioinformatics*, 2011. 27(20): 2866-72). Two main data subsets (clusters) were identified using sppPCA due to batch differences throughout the analysis which resulted in 2 unique "subsets" within the non-transplant data (Webb-Roberston et al., *Sequential Projection Pursuit PCA—dealing with missing data associated with new Omics technologies*. Biotechniques, 2013. in press; FIG. 8). The two subsets were processed independently, starting with a quality check to identify LC-MS runs that have significantly different peptide abundance distributions (FIGS. 9A-9D), and peptide normalization using a statistical procedure for the analysis of proteomic normalization strategies (SPANS) that identifies the peptide selection method and data scaling factor which introduces the least amount of bias into the dataset (Webb-Robertson et al., *Proteomics*, 2011. 11(24):4736-41). For each subset, the peptide abundance values were normalized across the technical replicates. Subset 1 data were normalized with mean scaling using L order statistics (5%) peptide subset; subset 2 data were normalized with z-score scaling using percentage of peptides present. Normalized $\log_{10}$ abundance values were averaged across the technical replicates within each biological sample. For each subset, peptide abundance values were evaluated with a Tukey adjusted t-test to identify quantitative and qualitative significance patterns, respectively.

A total of 532 proteins in subset 1 and 464 proteins in subset 2 were estimated using a peptide signature vector approach to protein quantitation. Peptide level significance patterns were used for protein roll-up to select peptides within a protein that follow the same significance trends to estimate protein abundance. Protein abundance values were estimated using a standard R-rollup method as previously described (Polpitiya et al., *Bioinformatics*, 2008. 24(13):1556-8). Comparative statistical analyses between the 3 fibrosis severity categories (fibrosis score=0; fibrosis score=1; fibrosis score=4, 5 or 6) were performed using a Tukey adjusted t-test to assess differences in protein average abundance.

A meta-analysis of protein significance from subsets 1 and 2 was performed using Fisher's Inverse Score. The meta-analysis approach provides a mechanism that allows inference be made to proteins using data across many experiments. Fisher's Inverse Score approach considers the p-values resulting from the comparative statistical analysis of proteins. The Fisher's Inverse statistic is defined as, $$S_{Fisher} = -2 \ln(\Pi_i \text{pvalue}_i)$$

The statistic $S_{Fisher}$ follows a $\chi 2$ distribution with degrees of freedom (df) equal to 2 times the number of datasets. When a protein was observed in both experiments the df=2*2, otherwise df=2*1. Significance is based on a p-value threshold of 0.05.

There are a combined total of 581 unique proteins and 415 in common across subsets 1 and 2. The results of the meta-analysis approach can be summarized in 4 parts, of which parts 1-3 are associated with proteins that are present in both subsets (p=415) and thus statistics can be compared between the two subsets, and part 4 shows the counts for the proteins that are unique to each subset (Table 10, Tukey adjusted t-test).

TABLE 10

Meta-analysis of protein significance using Tukey adjusted p-values. The number in meta-analysis results column (A/B) is the protein significance after the p-values have been combined using the Fishers Inverse $\chi 2$ test where A is the number significant and B is the number non-significant.

| Significance Indicator[1] | | Comparison (Score i vs. Score j) | | | | | |
|---|---|---|---|---|---|---|---|
| | | Fibrosis Score = 0 vs. Fibrosis Score = 1 | | Fibrosis Score = 0 vs. Fibrosis Score = 4/5/6 | | Fibrosis Score = 1 vs. Fibrosis Score = 4/5/6 | |
| Subset 1 (N = 42) | Subset 2 (N = 18) | Combined | Meta-analysis | Combined | Meta-analysis | Combined | Meta-analysis |
| Part 1. (df = 4) | | | | | | | |
| 1 | −1 | 0 | (0/0) | 0 | (0/0) | 0 | (0/0) |
| −1 | 1 | 0 | (0/0) | 0 | (0/0) | 0 | (0/0) |
| Part 2. (df = 4) | | | | | | | |
| +1 | +1 | 0 | (0/0) | 4 | (4/0) | 9 | (9/0) |
| −1 | −1 | 3 | (3/0) | 15 | (15/0) | 17 | (17/0) |
| 0 | 0 | 304 | (0/304) | 184 | (1/183) | 187 | (4/183) |
| Part 3. (df = 4) | | | | | | | |
| 1 | 0 | 17 | (13/4) | 23 | (20/3) | 17 | (11/6) |
| 0 | 1 | 2 | (2/0) | 10 | (5/5) | 11 | (9/2) |
| −1 | 0 | 13 | (5/8) | 37 | (23/7) | 22 | (18/4) |
| 0 | −1 | 10 | (4/6) | 26 | (16/10) | 21 | (14/7) |
| Part 4. (df = 2) | | | | | | | |
| +1 | NaN | 2 | (2/0) | 3 | (3/0) | 2 | (2/0) |
| NaN | +1 | 0 | (0/0) | 1 | (1/0) | 3 | (3/0) |

TABLE 10-continued

Meta-analysis of protein significance using Tukey adjusted p-values. The number in meta-analysis results column (A/B) is the protein significance after the p-values have been combined using the Fishers Inverse χ2 test where A is the number significant and B is the number non-significant.

| Significance Indicator[1] | | Comparison (Score i vs. Score j) | | | | | |
|---|---|---|---|---|---|---|---|
| | | Fibrosis Score = 0 vs. Fibrosis Score = 1 | | Fibrosis Score = 0 vs. Fibrosis Score = 4/5/6 | | Fibrosis Score = 1 vs. Fibrosis Score = 4/5/6 | |
| Subset 1 (N = 42) | Subset 2 (N = 18) | Combined | Meta-analysis | Combined | Meta-analysis | Combined | Meta-analysis |
| −1 | NaN | 11 | (11/0) | 2 | (2/0) | 3 | (3/0) |
| NaN | −1 | 3 | (3/0) | 0 | (0/0) | 0 | (0/0) |
| 0 | NaN | 82 | (0/82) | 68 | (0/68) | 66 | (0/66) |
| NaN | 0 | 35 | (0/35) | 19 | (0/19) | 16 | (0/16) |

[1]Significance indicator value (+1) indicates the protein is statistically significant in favor of Score j; (−1) indicates the protein is statistically significant in favor of Score i; (0) indicates there is no evidence of a statistical difference between Scores i & j; and, (NaN) indicates the protein was not present in a subset.

In Part 1 of Table 10, proteins are demonstrated that have conflicting "significance" information across the two subsets. That is, those proteins which were found to have a statistically significant difference in favor of one score groups but in favor of the other score group for the other subset. For the Tukey adjusted t-tests comparing protein abundances, no proteins were found with conflicting information.

In Part 2 of Table 10, proteins are demonstrated with consistent significance information across the two subsets. For a small number of proteins that are non-significant for both subsets, there is a gain in significance after the merging due to an increase in power.

In Part 3 of Table 10, proteins are demonstrated that are significant in one subset and non-significant in the other subset. There are proteins for which the combination of the p-values does not give evidence of significance, but others for which the combination of the significant with the non-significant p-value again increases the power and identifies significance.

In Part 4 of Table 10, proteins are demonstrated that are unique to one subset or the other. A value of "NaN" means that the protein is not present in that subset. To combine p-values, the p-value for the missing protein is set to 1.0 so that to achieve significance a protein would need to have a p-value of less than 0.009. A balance is observed between the number of proteins that are still identified as significant and those for which the p-value increases to a non-significant level.

Figure 10:
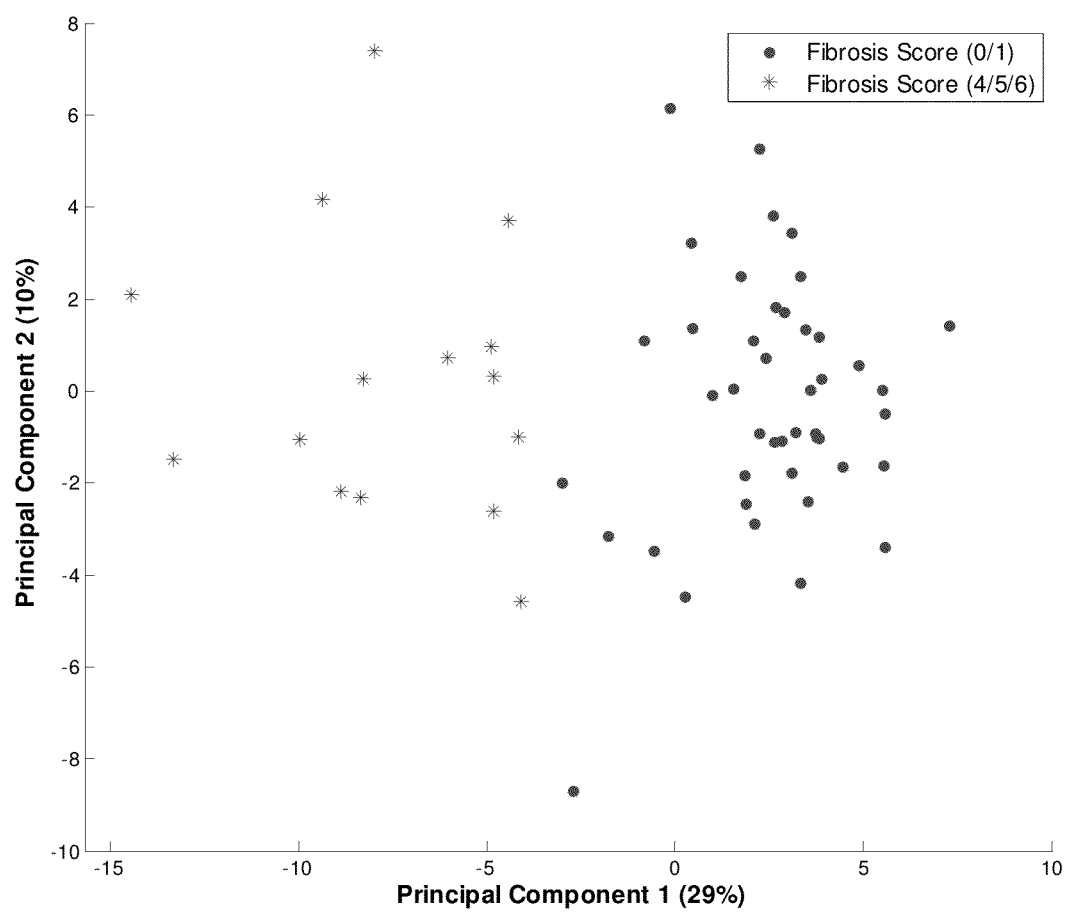
FIG. 10 is a plot showing the principal component analysis of the final protein candidate list. The first principal component explains 29% of the total variation in the protein abundance data, and discriminates the fibrosis categories.

The meta-analysis resulted in a non-redundant candidate list of 118 proteins which differentiate between 0.1 fibrosis and >4 fibrosis. After implementing similar coverage requirements as the transplant sample results (minimum 2 significant peptides per protein), the final candidate list consisted of 78 proteins. To further explore these proteins, within each subset, missing values were imputed using a regularized EM algorithm (Schneider, *J. Climate,* 2001. 14(5):853-871), then standardized across subsets using a z-score. A principal component analysis (PCA) based on the combination of the two subsets was used to determine a linear combination of the 75 proteins that discriminates fibrosis categories such that category 1 are those patients with a 0 or 1 fibrosis score and category 2 are those patients with a 4, 5 or 6 fibrosis score. The first principal component (pc) explained 26% of the total variation in the imputed and standardized protein abundance dataset. In addition, when the PCA scores are labeled by fibrosis category membership, a separation of the fibrosis categories is evident (FIG. 10).

A receiver operator characteristic (ROC) analysis was performed to assess and compare various biological metrics for their sensitivity to discriminate the fibrosis categories. The metrics included are (1) the 75 individual protein abundances (n=60), (2) the scores of the linear combination of the 75 proteins resulting in the first pc (n=60), (3) the APRI score (n=55), and (4) the FBS score (n=17). The scores of first pc, APRI scores and FBS scores all performed well in the discrimination problem resulting in area under the curve (AUC) values of 1.0, 0.93 and 0.98, respectively.

Western Blot Analyses

Aliquots of depleted serum samples (see above) from selected pairs of fibrosis and non-fibrosis patients were used. Briefly, 5 μg of each sample were electrophoresed using NuPage® Novex® 4-12% Bis-Tris SDS-PAGE gels (Life Technologies), alongside 5 μL SeeBlue® Plus2 Pre-stained Standard and 5 μL MagicMark™ XP Western Protein Standard (Life Technologies). Proteins were transferred to PVDF membranes followed by blocking with 5% non-fat dry milk in PBS containing 0.1% Triton X-100. Membranes were incubated overnight at 4° C. with primary antibodies at dilutions of 1:1000 or 1:500. Anti-QSOX1 was used at a 1:200 dilution for 1 h at room temperature. Secondary antibody incubations (1:5500) were carried out for 1 h at room temperature. All antibodies were from Santa Cruz biotechnology. SuperSignal West Femto Chemiluminescent Substrate (Thermo Scientific) was used for detection.

Example 2

IMS-MS Developments and Improvements to Increase Sensitivity and Duty Cycle

This example describes methods that were used to improve the sensitivity of protein detection by MS.

Practical use of IMS-MS was initially impeded by its low sensitivity due to significant ion losses at the IMS drift cell termini. This problem was solved by re-focusing both the ions exiting the source (prior to injection in the IMS drift cell) and those leaving the drift cell with ion funnels (FIG. 1A), making the addition of the IMS stage essentially lossless [13].

Another limitation that hindered widespread use of IMS-MS was its low duty cycle. Traditionally ions are only pulsed into the drift cell after all ions from the previous packet have exited, resulting in utilization of only a small percentage of the ions created in the source. To address this constraint, a multiplexing approach based on the Hadamard transform [14] was developed so that discreet packets of ions could co-exist in the drift cell as long as they did not overlap due to diffusional broadening (FIGS. 1B and 1C). This approach allows for much higher IMS duty cycle and has led to a significant increase in measurement sensitivity. Deconvolution of the pseudorandom sequence utilized in the multiplexing approach has also been shown to greatly reduce the noise in the spectra allowing a much higher signal to noise ratio for the resulting ions [15]. These improvements in addition to the reduced spectral congestion from the IMS separation have enabled faster gradient times when combined with LC, thereby increasing the throughput of sample analyses [12]. To take advantage of the faster sample analyses and higher sensitivity measurements, a LC-IMS-MS analytical platform was developed with the above sensitivity improvements for application to clinically focused large-scale proteomic measurements.

Example 3

LC-IMS-MS Platform Evaluation and Validation

This example shows application of the protein detection methods of Example 2 to detect expression of liver fibrosis related proteins.

In an initial evaluation of the new LC-IMS-MS platform, its performance was compared to an LC-MS platform (comprised of a commercially available LTQ Orbitrap Velos). Nine blood serum samples were analyzed on each platform, and a 100-min LC gradient was used for LC-MS, while a 60-min LC gradient was used for LC-IMS-MS. Even with the shorter analysis time, >20% more deisotoped spectral features (putative peptides) were detected with the LC-IMS-MS platform compared to the LC-MS platform (FIG. 2A), an observation attributed to the reduced spectral congestion from the additional IMS separation and the higher signal to noise ratios from multiplexing. These attributes allow additional coverage and confidence for the peptides observed with significant differential abundance in the LC-IMS-MS analyses and the detection of additional proteins not seen in the LC-MS experiments. To determine why more features were observed in the LC-IMS-MS platform even with a reduced LC gradient, a follow-up limit of detection study was performed and involved both platforms analyzing three technical replicates of a normal human serum sample spiked with eight non-human peptides ranging in concentrations from 100 pg/mL to 100 ng/mL. Overall, the LC-IMS-MS platform detected peptides at concentrations ~100× lower than the LC-MS platform with a linear correlation to concentrations, lower coefficient of variation (CV) values and modestly higher throughput (60-min vs. 100-min) as shown by Table 11 and FIG. 2B. These advantages illustrate the gains in enhanced dynamic range, proteome coverage, and increased speed for the LC-IMS-MS platform. To allow direct comparison of the TOF MS (60-min LC separation) to the LTQ Orbitrap Velos (100-min separation), the IMS drift cell was removed. The similarities in limits of detection for these two platforms (Table 11) showed that the increased measurement sensitivity observed with LC-IMS-MS can be attributed specifically to the IMS separation.

TABLE 11

Scaled abundance and coefficient of variation (CV) values for 8 non-human peptides spiked into human serum for 60-min LC-IMS-TOF MS, 60-min LC-TOF MS and 100-min LC-LTQ Orbitrap Velos analyses

| | | Peptide Scaled Abundance[a] and CV Values[b,c] | | |
| --- | --- | --- | --- | --- |
| Spiking Level | Peptide | 60-min LC-IMS-TOF MS | 60-min LC-TOF MS | 100-min LC-LTQ Orbitrap Velos |
| 100 pg/mL | Melittin | ND | ND | ND |
| 100 pg/mL | Dynorphin A Porcine | 1.7 (18) | ND | ND |
| 1 ng/mL | Des Pro Ala Bradykinin | 21 (12) | ND | ND |
| 1 ng/mL | Leucine Enkephalin | 23 (10) | ND | ND |
| 10 ng/mL | 3X FLAG Peptide | 115 (8) | 125 (20) | ND |
| 10 ng/mL | Substance P | 126 (7) | 138 (18) | 112 (19) |
| 100 ng/mL | [Ala92]-Peptide 6 | 868 (4) | 848 (11) | 841 (12) |
| 100 ng/mL | Methionine Enkephalin | 1000 (3) | 1000 (9) | 1000 (10) |

[a]Peptide abundance values from 3 datasets were averaged and re-scaled to a range of 0 to 1000 for direct instrument comparison (by dividing the most abundant peptide value in each instrument and multiplying by 1000)
[b]CV values are in parenthesis
[c]ND = not detected

Example 4

Statistical Trends for Proteins with Significant Differential Abundance Discriminating between Fibrosis Conditions This example shows assessment of the statistical significance of data obtained using the protein detection methods of the preceding Examples towards detection of liver fibrosis related proteins.

To fully evaluate its applicability, the LC-IMS-MS platform was utilized in a study involving chronic liver disease, which is associated with a variety of origins, including viral hepatitis, alcohol abuse, nonalcoholic fatty liver disease and hepatic metabolic and immune disorder. Specifically matched blood serum samples chosen from 60 HCV patients following liver transplantation were initially utilized to evaluate the LC-IMS-MS platform for clinical use. These 60 samples represented 30 patients termed non-progressors (NP) who showed no or mild return of fibrosis over a range of times post-liver transplant (2 to 4 years), compared with 30 patients who developed "stage 3 to 4" fibrosis over a similar period of time and were stratified into either slow progressors (SP; stage 3-4 fibrosis at 3-4 years post-transplant) or fast progressors (FP; stage 3-4 fibrosis within 2 years post-transplant) (FIG. 3). The serum samples were collected at specific time points post-transplant (ranging between 150 and 771 days with in depth information on the patient cohort available in Reference [21] and its Supporting Material). Using a multivariant approach, the specimens were matched for the most important clinical variables known to influence the risk of fibrosis progression associated with recurrent HCV after liver transplantation: donor age and cold ischemia time of the transplanted organ. Time to biopsy was also matched and multiple inclusion and exclusion criteria were applied, specifically patients with known confounders for fibrosis, such as CMV infection, greater than 1 episode of rejection, etc. were excluded. The specimens were adequately found and matched for these confounders due to the extensive number of patient samples available through the University of Washington Tissue Repository. Final matching resulted in 30 patient pairs (progressor vs. non-progressor), across both slow (14) and fast (16) fibrosis progression outcomes. All serum samples were analyzed utilizing the LC-IMS-MS platform with technical replicates allowing for global proteome evaluation of each patient sample.

Following data acquisition of the 60 HCV liver transplant serum samples with LC-IMS-MS, overall statistical significance was assessed, first at the peptide level and then protein significance was evaluated after merging peptide with significant differential abundance values distinguishing NP, SP, and FP conditions. If a protein was identified with only one significant non-unique peptide it was removed. In DAnTE software, peptide peak intensity values were converted to a log 2 scale statistically compared utilizing ANOVA (performed as a t-test with only two data types in each comparison) [22]. The analysis only focused on significantly changing peptides (p-values and q-values <0.05). The q-value of a test measures the proportion of false positives incurred (called the false discovery rate) when that particular test is called significant. Significantly changing peptides were assessed at a protein level using DAnTE's Rollup parameters (reference peptide based scaling). Statistically comparisons were also done at the protein level. Only significantly changing proteins were retained (some peptides were significant but they were in opposing directions, so the proteins were not significant when the peptides were rolled up). Final significant proteins identified required at least two significant peptide identifications. Statistical analysis revealed 136 differentially abundant proteins in the serum of transplant patients, 112 proteins were observed to discriminate between the NP and FP patient groups and 101 proteins between NP and SP patient groups, with 77 proteins overlapping, illustrated in FIG. 4A.

Example 5

Functional Classification and Comparison with Previous Finding

This example shows contextual analysis of some of the liver fibrosis related proteins that show differential expression using the protein detection methods of the preceding Examples.

Figure 4B:
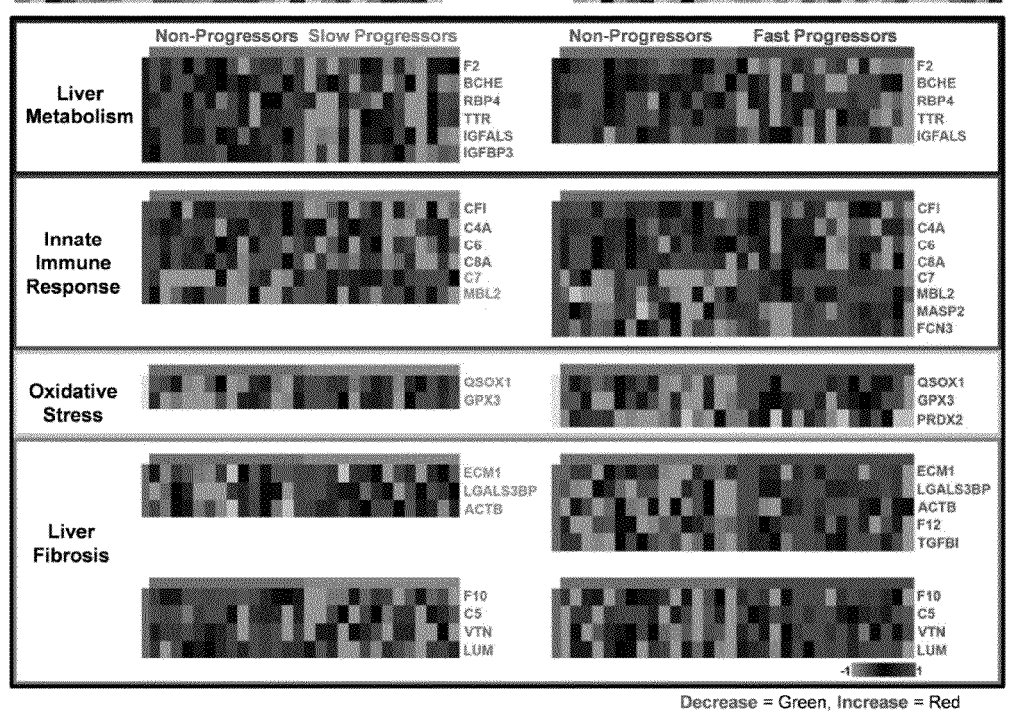
FIG. 4B provides heat maps illustrating the categorization of selected proteins with significant differential expression into four groups based on correlation with liver metabolism, innate immune response, oxidative stress or liver fibrosis. Gene names given in UniProtKB are used as abbreviated protein names. The twenty-five selected proteins are shown to illustrate the trend of each category. Decrease in relative expression is shown by green and increase in relative expression is shown by red (missing values are shown as grey).

Serum results were functionally classified, focusing on certain mechanisms relevant for comparison within liver function: liver metabolism, immune response (innate and adaptive), oxidative stress, architecture, and secreted effectors (Table 12, FIG. 4B). General trends reveal a decrease in serum level markers of liver metabolism for patients with developed fibrosis, while those related to oxidative stress increase (as seen in [23]). Mechanistically, this reflects a reduction in gross metabolism, in line with attenuation of liver function, but appears to do so under significant oxidative stress resulting in the production of stress response proteins. As with any comprehensive serum/plasma protein study, multiple signature immune proteins where also captured, including alterations in adaptive immunoglobulin responses, acute phase and inflammatory markers, and the complement pathway. Though likely not specific as markers of fibrosis progression, these signatures still reflect the gross alterations visible in this biofluid as a direct result of liver injury. Of specific relevance to HCV infection however, complement C4-A exhibited lower abundance in the SP and FP patient groups. Recent papers [24, 25] have shown that complement C4 activity is significantly lower in HCV infected patients because it is transcriptionally repressed by HCV proteins, consistent with the data.

TABLE 12

| | Gene | Transplant Model Fast Progressors vs their matched controls | Transplant Model Slow Progressors vs their matched controls | Fibrosis Model >Stage 4 Fibriosis |
|---|---|---|---|---|
| Proteins significantly increasing in the Slow and Fast Progressors (SP & FP) compared to their matched controls | | | | |
| Oxidative Stress | QSOX1 | ↑ | ↑ | ↑ |
| | IGLC1 | ↑ | ↑ | ↑ |
| | FCGR3A | ↑ | ↑ | ↑ |
| | A2M | ↑ | ↑ | ↑ |

TABLE 12-continued

| | Gene | Transplant Model Fast Progressors vs their matched controls | Transplant Model Slow Progressors vs their matched controls | Fibrosis Model >Stage 4 Fibriosis |
|---|---|---|---|---|
| | AFM | ↑ | ↑ | ↑ |
| | ALCAM | ↑ | ↑ | ↑ |
| | APOB | ↑ | ↑ | ↓ |
| | C7 | ↑ | ↑ | ↓ |
| | CLU | ↑ | ↑ | ↓ |
| Liver Architecture | ECM1 | ↑ | ↑ | ↑ |
| | ITIH3 | ↑ | ↑ | ↑ |
| Liver Architecture | LGALS3BP | ↑ | ↑ | ↑ |
| | VCAM1 | ↑ | ↑ | ↑ |
| | VWF | ↑ | ↑ | ↑ |

Proteins significantly decreasing in the Slow and Fast Progressors (SP & FP) compared to their matched controls

| | Gene | | | |
|---|---|---|---|---|
| Liver Metabolism | F2 | ↓ | ↓ | ↓ |
| | CFI | ↓ | ↓ | ↓ |
| | KLKB1 | ↓ | ↓ | ↓ |
| | F11 | ↓ | ↓ | ↓ |
| | CNDP1 | ↓ | ↓ | ↓ |
| Liver Metabolism | BCHE | ↓ | ↓ | ↓ |
| | APCS | ↓ | ↓ | ↓ |
| | APOH | ↓ | ↓ | ↓ |
| | AZGP1 | ↓ | ↓ | ↓ |
| Immune | C4A | ↓ | ↓ | ↓ |
| | C6 | ↓ | ↓ | ↓ |
| | C8A | ↓ | ↓ | ↓ |
| | C8B | ↓ | ↓ | ↓ |
| | C8G | ↓ | ↓ | ↓ |
| | HPX | ↓ | ↓ | ↓ |
| Liver Metabolism | IGFALS | ↓ | ↓ | ↓ |
| | ITIH1 | ↓ | ↓ | ↓ |
| | ITIH2 | ↓ | ↓ | ↓ |
| | ITIH4 | ↓ | ↓ | ↓ |
| | PRG4 | ↓ | ↓ | ↓ |
| Liver Metabolism | RBP4 | ↓ | ↓ | ↓ |
| | SERPINC1 | ↓ | ↓ | ↓ |
| | SERPIND1 | ↓ | ↓ | ↓ |
| Liver Metabolism | TTR | ↓ | ↓ | ↓ |
| | APOC3 | ↓ | ↓ | ↓ |

Proteins showing differentaly abundance changes in the Slow and Fast Progressors (SP & FP) compared to their matched controls - Up in FP/Down in SP

| | Gene | | | |
|---|---|---|---|---|
| Liver Architecture | F10 | ↑ | ↓ | ↓ |
| | SERPINA4 | ↑ | ↓ | ↓ |
| Liver Architecture | VTN | ↑ | ↓ | ↑ |
| Liver Architecture | LUM | ↑ | ↓ | ↑ |

Proteins significantly increasing/decreasing only in the Slow Progressors (SP) compared to their matched controls

| | Gene | | | |
|---|---|---|---|---|
| | SERPING1 | | ↑ | ↑ |
| | BTD | | ↓ | ↓ |
| | PLG | | ↓ | ↓ |
| | PROC | | ↓ | ↓ |
| | CPN1 | | ↓ | ↓ |
| | CPB2 | | ↓ | ↓ |
| | GC | | ↓ | ↓ |
| | GP5 | | ↓ | ↓ |

Proteins significantly increasing/decreasing in the Fast Progressors (FP) compared to their matched controls

| | Gene | | | |
|---|---|---|---|---|
| | C2 | ↑ | | ↓ |
| Liver Architecture | F12 | ↑ | | ↓ |
| | ANPEP | ↑ | | ↑ |
| | CP | ↑ | | ↑ |
| Liver Architecture | TGFBI | ↑ | | ↑ |
| | FCGBP | ↑ | | ↑ |
| | SERPINA7 | ↓ | | ↓ |
| | PVR | ↑ | | ↑ |
| | AGT | ↓ | | ↓ |
| | H6PD | ↓ | | ↓ |
| | PROCR | ↑ | | ↑ |
| | VASN | ↑ | | ↑ |

TABLE 12-continued

| Gene | Transplant Model Fast Progressors vs their matched controls | Transplant Model Slow Progressors vs their matched controls | Fibrosis Model >Stage 4 Fibriosis |
|---|---|---|---|
| Proteins significantly increasing/decreasing only in AK dataset | | | |
| Ig lambda chain V-I region NEWM | | | ↑ |
| APOC1 | | | ↑ |
| ICAM1 | | | ↑ |
| CSF1R | | | ↑ |
| DBH | | | ↑ |
| COL6A3 | | | ↑ |
| COMP | | | ↑ |
| CD163 | | | ↑ |
| LYVE1 | | | ↑ |
| LCAT | | | ↓ |
| CPN2 | | | ↓ |
| PROZ | | | ↓ |
| MASP1 | | | ↓ |
| SEPP1 | | | ↓ |
| RARRES2 | | | ↓ |

Trends were observed in the panel of liver architecture proteins allowing for differentiation of the NP, SP, and FP patient groups. Extracellular matrix proteins such as ECM1 and galectin-3-binding proteins, which contribute to the collagenous matrix of the fibrotic tissue in chronic hepatic fibrosis, both increased in SP and FP patient groups, as well as cytoskeletal β-actin (ACTB) which increases in a radiation-induced skin and muscular fibrosis study [26]. A significant increase was observed in FP patients for transforming growth factor-β-induced protein ig-h3 (TGFBI) and coagulation factor XII (F12). Finally, differential responses were observed in some protein markers such as vitronectin (VTN), lumican (LUM), coagulation factor X (F10) and complement factor 5 (C5), which decrease in SP, but increase in FP.

Recent efforts report complementary mRNA and protein level characterization of liver-transplant biopsy tissue collected from a patient population which overlaps, in part, with the current serum samples [30, 31]. Previous tissue studies were longitudinal in nature, including early and late post-transplant, and accurately describe the gene and protein expression patterns and networks that differentially distinguish severity of fibrosis progression post-transplant. When comparing the liver tissue and serum results a strong oxidative stress environment and response directly linked to liver injury is reflected in both liver tissue and through protein serum levels. This is confirmed through metabolite analysis performed on the same serum samples, showing a unique metabolic profile categorized by metabolite alterations in glutathione hemostasis and oxidative stress [30], consistent with previous finding [32, 33]. Alterations in both adaptive and innate immune responses are also in common and consistent with other HCV-associated fibrosis transplant studies [30, 34]. Finally, indications of liver function attenuation (reduction in metabolism and secretion of effectors), were also reflected in both the serum and tissue findings and correlated with fibrosis progression [30].

This initial application of the LC-IMS-MS platform demonstrates a robust characterization of potential differentiating serum proteins, with faster throughput (40% gain) while maintaining or exceeding sensitivity compared to current conventional platforms (Table 11).

Example 6

Non-Transplant Patient Serum Verification Analysis and Comparison

This example shows validation of results obtained on transplant patients with liver fibrosis using protein detection methods of the preceding Examples against results obtained using the methods on non-transplant liver fibrosis subjects.

Figure 5A:
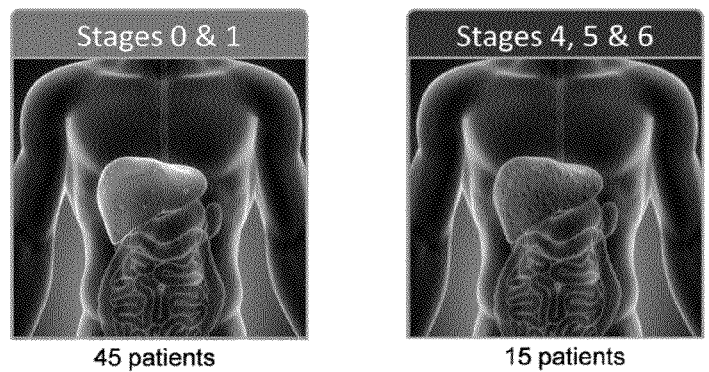
FIG. 5A illustrates the categorization of 60 HCV infected non-transplant patients into two categories, Stages 0 & 1 and Stages 4, 5 & 6. Blood samples from the 60 HCV infected non-transplant patients were utilized for comparison and validation of the transplant patient results.

Investigations utilizing a liver transplant patient population confer multiple advantages in studies involving fibrosis progression (part of which is the rapidity with which fibrosis develops post-transplant), but it is recognized that such studies also introduce clinical confounders and variables not mechanistically linked to progression of liver fibrosis but directly related to the transplantation itself and immunosuppressive environments. These factors likely add analytical complexity to an already dynamic clinical investigation. To provide clarity towards significant findings from the transplant model and at the same time verify the subset of detected serum proteins which are directly related to fibrosis progression, the LC-IMS-MS platform described above was utilized to survey a completely independent HCV-infected but non-transplant patient cohort). A total of 60 patient serum samples were identified and analyzed based upon fibrosis stratification of Ishak score 0-1 versus 4-6, with timeframe of sampling within 6 months of a diagnostic biopsy as shown in FIG. 5A.

Figure 5B:
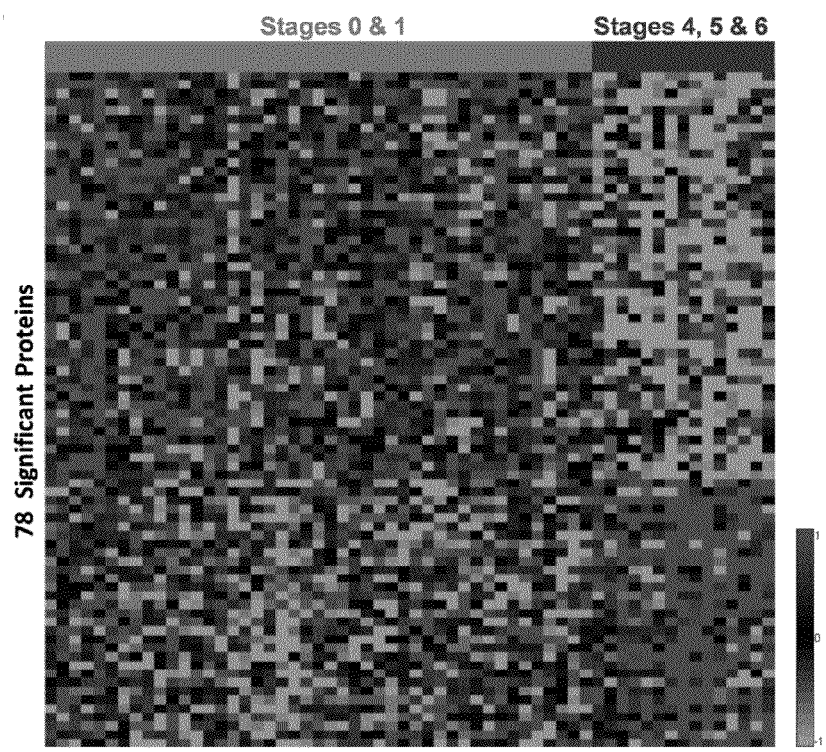
FIG. 5B provides heat maps illustrating the relative log 2 intensity change for proteins showing significant differential expression in the non-transplant patient groups. Each column represents one of the 60 patients and each row one of the 78 significant proteins shown in Table 5. Trends between the patient groups are clearly observed, but biodiversity in the human population is also discerned. Decrease in relative abundance is shown by green and increase by red.

Statistical analysis of the subsequent peptide and protein results was performed using an independent analysis pipeline (See Example 1 for details) which resulted in the orthogonal identification of 78 proteins (see Table 5) which differentiate between the fibrosis classes (FIG. 5B). Notably, 81% of these proteins (63) overlap with those that significantly differentiate fibrosis progression in the initial transplant patient results, with the majority (43) overlapping with those in common between SP and FP. Additionally, after excluding 4 proteins which decrease in SP, but increase in FP, >91% are observed with common abundance directionality, providing a strong orthogonal validation of core proteins based upon both transplant and non-transplant studies. Furthermore, of the 14 proteins uniquely significant in the non-transplant data, half have supporting significant peptides in the transplant data, but were initially excluded due to lack of multiple peptides per protein. (See Table 12 for protein overlap information)

Beyond validation purposes, comparison of the transplant and non-transplant results provides evidence concerning the liver fibrosis specificity of serum protein levels, and aids in identifying signatures which may be more driven by the transplant environment. The core observations previously observed with the transplant study still hold in the non-transplant results. Specifically, as seen in the proteins depicted in FIG. 4B, decreases are still consistent in liver metabolism, proteins F2, BCHE, RBP4, TTHY and IGFALS; decreasing immune response protein CO4A; increasing oxidative stress protein QSOX1; and increasing liver architecture proteins ECM1, LGALS3BP and TGFBI. Other verified proteins previously described include HPX, AGT, PROC and A2M. Thus, in some examples the disclosed methods and systems use at least (a) F2, BCHE, RBP4, TTHY, IGFALS, CO4A, QSOX1, ECM1, LGALS3BP and TGFBI, or (b) F2, BCHE, RBP4, TTHY, IGFALS, CO4A, QSOX1, ECM1, LGALS3BP, TGFBI, HPX, AGT, PROC and A2M. With regard to the subset of serum markers found only with transplant results, a much more robust adaptive immune response is seen, in both the number and magnitude of immunoglobulin related serum identifications, which is partially observed in the non-transplant results (Table 12). Additionally, a number of general hepatic classical serum/plasma proteins, ALB, ORM2, ORM1, A1AT, HBB, HP, APOA1, APOA2 and CO3, were also uniquely significant in the transplant model but not verified in the non-transplant results. Interestingly most of these proteins were immunoaffinity depleted prior to platform analysis, so their initial differential abundance was based upon either detection of an altered protein state (confirmation change, denature or degraded form), or their protein abundance was altered enough to overwhelm capture on the affinity column.

Example 7

Comparison with Current Metrics of Fibrosis Progression

This example compares fibrosis tracking performance obtainable using the LC-IMS-MS improved sensitivity protein detection method against current metrics for fibrosis progression. This example also validates results from the LC-IMS-MS platform for five proteins showing differential expression in both the transplant and non-transplant patient groups using Western blot immunoassays.

There are several current clinically applied tests and measures to track fibrosis progression in patients, two of which, APRI calculation [39] and FIBROSpect score [40], where measured herein and were compared with the identified protein signatures. Using the non-transplant results, a receiver operator characteristic (ROC) comparative analysis was performed comparing 75 identified and quantified protein values (78 minus the removal of immunoglobulin IDs) with measured FIBROSpect scores (n=17) and the calculated APRI score (n=60).

The set of 75 serum proteins detected by LC-IMS-MS was able to achieve a full discrimination of patients, area under the curve (AUC)=1, compared to FIBROSpect AUC=0.98 and APRI AUC=0.93. FIBROSpect results are in line with previous studies which showed its clear utility to discrimination between advanced and mild disease (0.1 Ishak versus >4 Ishak) [41]. However there are limitations for both sensitivity and selectivity when reporting the FIBROSpect middle test range (correlation to Ishak 2-3) [41]. The current protein markers performed as well as FIBROSpect scores in discrimination of mild versus advanced disease, and a comprehensive list of markers, as presented, may perform well in middle disease determination, which would be a significant benefit over currently available measures.

Figure 6:
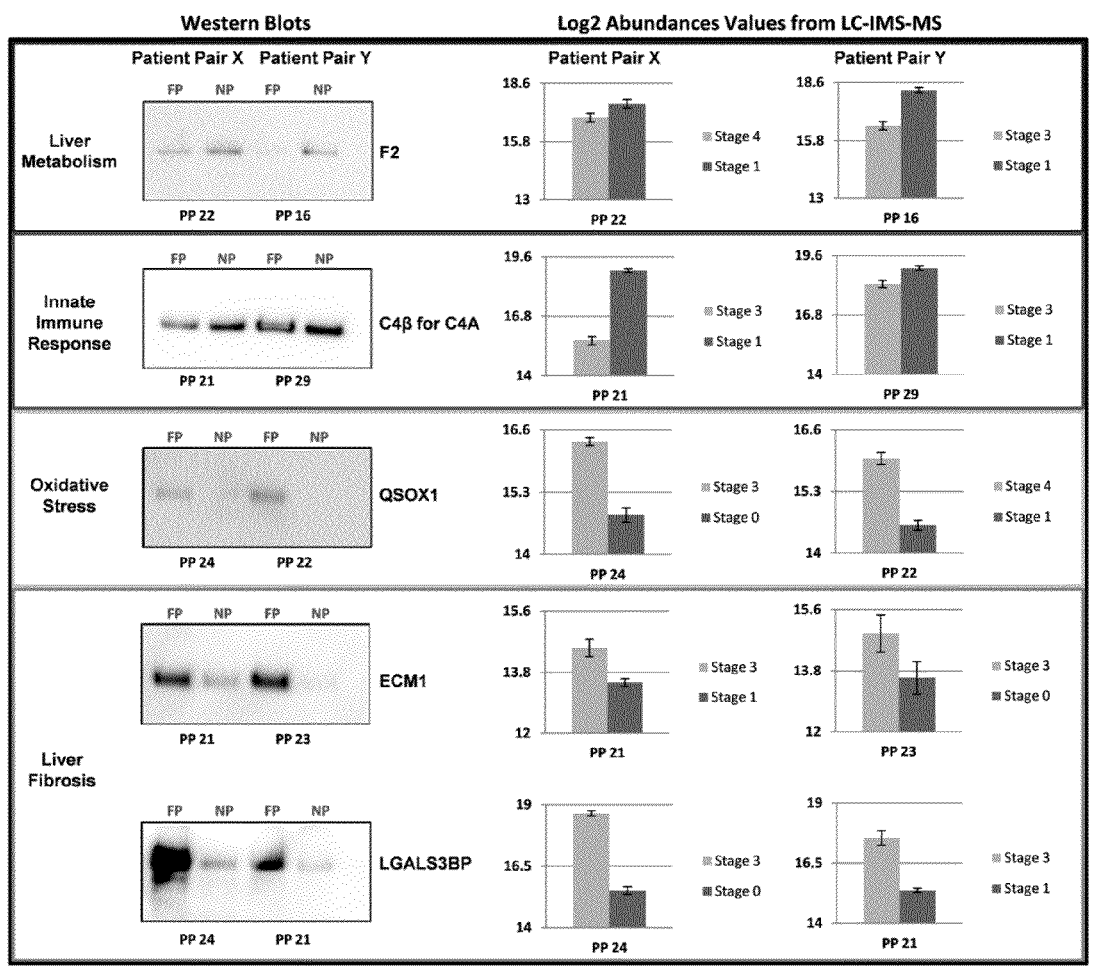
FIG. 6 illustrates Western blot (left) and LC-IMS-MS abundance (right) analyses of certain liver fibrosis patients where fast progressors (FP) were analyzed against their matched controls (NP). Patient fibrosis stage is noted on the bar graphs for the LC-IMS-MS abundance data. Patient pair is abbreviated as PP for clarity. For the Western blots an equal amount (5 µg) of each serum protein sample was loaded. Targets were proteins involved in liver metabolism (F2: patient pairs 22 and 16), the innate immune system (C4A: patient pairs 21 and 29 (the Western targeted C4 β-chain, a cleavage product of C4A), oxidative stress (QSOX1: patient pairs 24 and 22) and liver fibrosis (ECM1: patient pairs 21 and 23 and LGALS3BP: patient pairs 24 and 21).

To provide a more traditional validation of the results from the LC-IMS-MS platform, a limited subset of Western blot immunoassays were performed on five proteins with significant differential abundance in both the transplant and non-transplant patients groups (F2, C4A, QSOX1, ECM1 and LGALS3BP). Within the LC-IMS-MS studies, F2 and C4A both decrease in patients with fibrosis while QSOX1, ECM1 and LGALS3BP increase. These results were essentially mirrored in the immunoassay blot results where two transplant NP-FP patient pair serum samples were blotted for each protein as shown in FIG. 6. The corresponding bar graphs represent the LC-IMS-MS measured protein values, providing an orthogonal validation of LC-IMS-MS platform.

REFERENCES

1. Picotti P, Rinner O, Stallmach R, Dautel F, Farrah T, Domon B, et al. High-throughput generation of selected reaction-monitoring assays for proteins and proteomes. Nat Methods. 2010; 7(1):43-6.
2. Addona T A, Abbatiello S E, Schilling B, Skates S J, Mani D R, Bunk D M, et al. Multi-site assessment of the precision and reproducibility of multiple reaction monitoring-based measurements of proteins in plasma. Nat Biotechnol. 2009; 27(7):633-41. PMCID: 2855883.
3. Roschinger W, Olgemoller B, Fingerhut R, Liebl B, Roscher A A. Advances in analytical mass spectrometry to improve screening for inherited metabolic diseases. Eur J Pediatr. 2003; 162 Suppl 1:S67-76.
4. Gallien S, Duriez E, Domon B. Selected reaction monitoring applied to proteomics. J Mass Spectrom. 2011; 46(3): 298-312.
5. Woodcock J. The prospects for "personalized medicine" in drug development and drug therapy. Clin Pharmacol Ther. 2007; 81(2):164-9.
6. Chan I S, Ginsburg G S. Personalized medicine: progress and promise. Annu Rev Genomics Hum Genet. 2011; 12:217-44.
7. Hutchinson L. Personalized cancer medicine: era of promise and progress. Nat Rev Clin Oncol. 2011; 8(3):121.
8. Shen Y F, Zhao R, Berger S J, Anderson G A, Rodriguez N, Smith R D. High-efficiency nanoscale liquid chromatography coupled on-line with mass spectrometry using nano-electrospray ionization for proteomics. Analytical Chemistry. 2002; 74(16):4235-49.
9. Mason E, McDaniel E. Transport Properites of Ions in Gases. New York: Wiley; 1988.
10. Guevremont R, Siu K W, Wang J, Ding L. Combined Ion Mobility/Time-of-Flight Mass Spectrometry Study of Electrospray-Generated Ions. Anal Chem. 1997; 69(19): 3959-65.
11. Sowell R A, Koeniger S L, Valentine S J, Moon M H, Clemmer D E. Nanoflow LC/IMS-MS and LC/IMS-CID/MS of protein mixtures. J Am Soc Mass Spectrom. 2004; 15(9):1341-53.
12. Baker E S, Livesay E A, Orton D J, Moore R J, Danielson W F, 3rd, Prior D C, et al. An LC-IMS-MS platform providing increased dynamic range for high-throughput proteomic studies. J Proteome Res. 2010; 9(2):997-1006. PMCID: 2819092.
13. Tang K, Shvartsburg A A, Lee H N, Prior D C, Buschbach M A, Li F, et al. High-sensitivity ion mobility spectrometry/mass spectrometry using electrodynamic ion funnel interfaces. Anal Chem. 2005; 77(10):3330-9. PMCID: 1829302.

14. Belov M E, Buschbach M A, Prior D C, Tang K, Smith R D. Multiplexed ion mobility spectrometry-orthogonal time-of-flight mass spectrometry. Anal Chem. 2007; 79(6): 2451-62. PMCID: 3302721.

15. Clowers B H, Belov M E, Prior D C, Danielson W F, 3rd, Ibrahim Y, Smith R D. Pseudorandom sequence modifications for ion mobility orthogonal time-of-flight mass spectrometry. Anal Chem. 2008; 80(7):2464-73. PMCID: 2516355.

16. Llovet J M, Burroughs A, Bruix J. Hepatocellular carcinoma. Lancet. 2003; 362:1907-17.

17. Charlton M, Ruppert K, Belle S H, Bass N, Schafer D, Wiesner R H, et al. Long-term results and modeling to predict outcomes in recipients with HCV infection: results of the NIDDK liver transplantation database. Liver Transpl. 2004; 10:1120-30.

18. Thomson 13.1, Finch R G. Hepatitis C virus infection. Clin Microbiol Infect. 2005; 11:86-94.

19. Mukherjee S, Sorrell M F. Noninvasive tests for liver fibrosis. Semin Liver Dis. 2006; 26(4):337-47.

20. Plebani M, Basso D. Non-invasive assessment of chronic liver and gastric diseases. Clin Chim Acta. 2007; 381(1): 39-49.

21. Diamond D L, Krasnoselsky A L, Burnum K E, Monroe M E, Webb-Robertson B J, McDermott J E, et al. Proteome and computational analyses reveal new insights into the mechanisms of hepatitis C virus-mediated liver disease posttransplantation. Hepatology. 2012; 56(1):28-38. PMCID: 3387320.

22. Polpitiya A D, Qian W J, Jaitly N, Petyuk V A, Adkins J N, Camp D G, 2nd, et al. DAnTE: a statistical tool for quantitative analysis of -omics data. Bioinformatics. 2008; 24(13):1556-8. PMCID: 2692489.

23. Diamond D L, Jacobs J M, Paeper B, Proll S C, Gritsenko M A, Carithers R L, Jr., et al. Proteomic profiling of human liver biopsies: hepatitis C virus-induced fibrosis and mitochondrial dysfunction. Hepatology. 2007; 46(3):649-57.

24. Imakiire K, Uto H, Sato Y, Sasaki F, Mawatari S, Ido A, et al. Difference in serum complement component C4a levels between hepatitis C virus carriers with persistently normal alanine aminotransferase levels or chronic hepatitis C. Mol Med Report. 2012; 6(2):259-64.

25. Banerjee A, Mazumdar B, Meyer K, Di Bisceglie A M, Ray R B, Ray R. Transcriptional repression of C4 complement by hepatitis C virus proteins. J. Virol. 2011; 85(9): 4157-66. PMCID: 3126272.

26. Martin M, Lefaix J L, Pinton P, Crechet F, Daburon F. Temporal modulation of TGF-beta 1 and beta-actin gene expression in pig skin and muscular fibrosis after ionizing radiation. Radiat Res. 1993; 134(1):63-70.

27. Jablonska E, Markart P, Zakrzewicz D, Preissner K T, Wygrecka M. Transforming growth factor-beta1 induces expression of human coagulation factor XII via Smad3 and JNK signaling pathways in human lung fibroblasts. J Biol Chem. 2010; 285(15):11638-51. PMCID: 2857041.

28. Scotton C J, Krupiczojc M A, Konigshoff M, Mercer P F, Lee Y C, Kaminski N, et al. Increased local expression of coagulation factor X contributes to the fibrotic response in human and murine lung injury. J Clin Invest. 2009; 119(9): 2550-63. PMCID: 2735922.

29. Hillebrandt S, Wasmuth H E, Weiskirchen R, Hellerbrand C, Keppeler H, Werth A, et al. Complement factor 5 is a quantitative trait gene that modifies liver fibrogenesis in mice and humans. Nat Genet. 2005; 37(8):835-43.

30. Diamond D L, Krasnoselski A, Burnum K E, Susnow N, Webb-Robertson B J, McDermott J E, et al. Proteome and Computational Analyses Reveal New Insights into the Mechanisms of Hepatitis C Virus Mediated Liver Disease Post-Transplantation. Hepatology. 2012; in press.

31. Rasmussen A L, Tchitchek N, Susnow N J, Krasnoselsky A L, Diamond D L, Yeh M M, et al. Early transcriptional programming links progression to hepatitis C virus-induced severe liver disease in transplant patients. Hepatology. 2012; 56(1):17-27. PMCID: 3349763.

32. Soga T, Sugimoto M, Honma M, Mori M, Igarashi K, Kashikura K, et al. Serum metabolomics reveals gamma-glutamyl dipeptides as biomarkers for discrimination among different forms of liver disease. Journal of hepatology. 2011; 55(4):896-905.

33. Roe B, Kensicki E, Mohney R, Hall W W. Metabolomic profile of hepatitis C virus-infected hepatocytes. PloS one. 2011; 6(8):e23641. PMCID: 3154941.

34. Smith M W, Walters K A, Korth M J, Fitzgibbon M, Proll S, Thompson J C, et al. Gene expression patterns that correlate with hepatitis C and early progression to fibrosis in liver transplant recipients. Gastroenterology. 2006; 130(1):179-87.

35. Qin S, Zhou Y, Lok A S, Tsodikov A, Yan X, Gray L, et al. SRM targeted proteomics in search for biomarkers of HCV-induced progression of fibrosis to cirrhosis in HALT-C patients. Proteomics. 2012; 12(8):1244-52.

36. Cheung K J, Libbrecht L, Tilleman K, Deforce D, Colle I, Van Vlierberghe H. Galectin-3-binding protein: a serological and histological assessment in accordance with hepatitis C-related liver fibrosis. Eur J Gastroenterol Hepatol. 2010; 22(9):1066-73.

37. Cheung K J, Tilleman K, Deforce D, Colle I, Moreno C, Gustot T, et al. Usefulness of a novel serum proteome-derived index FI-PRO (fibrosis-protein) in the prediction of fibrosis in chronic hepatitis C. Eur J Gastroenterol Hepatol. 2011; 23(8):701-10.

38. Bell L N, Theodorakis J L, Vuppalanchi R, Saxena R, Bemis K G, Wang M, et al. Serum proteomics and biomarker discovery across the spectrum of nonalcoholic fatty liver disease. Hepatology. 2010; 51(1):111-20. PMCID: 2903216.

39. Borsoi Viana M S, Takei K, Collarile Yamaguti D C, Guz B, Strauss E. Use of AST platelet ratio index (APRI Score) as an alternative to liver biopsy for treatment indication in chronic hepatitis C. Annals of hepatology. 2009; 8(1):26-31.

40. Patel K, Gordon S C, Jacobson I, Hezode C, Oh E, Smith K M, et al. Evaluation of a panel of non-invasive serum markers to differentiate mild from moderate-to-advanced liver fibrosis in chronic hepatitis C patients. Journal of hepatology. 2004; 41(6):935-42.

41. Christensen C, Bruden D, Livingston S, Deubner H, Homan C, Smith K, et al. Diagnostic accuracy of a fibrosis serum panel (FIBROSpect II) compared with Knodell and Ishak liver biopsy scores in chronic hepatitis C patients. Journal of viral hepatitis. 2006; 13(10):652-8.

42. Baker E S, Clowers B H, Li F, Tang K, Tolmachev A V, Prior D C, et al. Ion mobility spectrometry-mass spectrometry performance using electrodynamic ion funnels and elevated drift gas pressures. J Am Soc Mass Spectrom. 2007; 18(7):1176-87. PMCID: 3292285.

43. Livesay E A, Tang K, Taylor B K, Buschbach M A, Hopkins D F, LaMarche B L, et al. Fully Automated Four-Column Capillary LC-MS System for Maximizing Throughput in Proteomic Analyses. Analytical Chemistry. 2007; 80(1):294-302.

In view of the many possible embodiments to which the principles of the disclosure may be applied, it should be recognized that the illustrated embodiments are only examples of the disclosure and should not be taken as limiting the scope of the invention. Rather, the scope of the disclosure is defined by the following claims. We therefore claim as our invention all that comes within the scope and spirit of these claims.

SEQUENCE LISTING (5544 sequences)

SEQ ID NO: 1 - protein, 11 aa, Homo sapiens
PVNLPGEHGQR

SEQ ID NO: 2 - protein, 17 aa, Homo sapiens
KALLAYAFALAGNQDKR

SEQ ID NO: 3 - protein, 12 aa, Homo sapiens
EGDFLAEGGGVR

SEQ ID NO: 4 - protein, 16 aa, Homo sapiens
ADSGEGDFLAEGGGVR

SEQ ID NO: 5 - protein, 16 aa, Homo sapiens
HGLSNSIYVFVRDPAK

SEQ ID NO: 6 - protein, 13 aa, Homo sapiens
GEGDFLAEGGGVR

SEQ ID NO: 7 - protein, 15 aa, Homo sapiens
DSGEGDFLAEGGGVR

SEQ ID NO: 8 - protein, 14 aa, Homo sapiens
SGEGDFLAEGGGVR

SEQ ID NO: 9 - protein, 10 aa, Homo sapiens
DFLAEGGGVR

SEQ ID NO: 10 - protein, 20 aa, Homo sapiens
LRTEGDGVYTLNNEKQWINK

SEQ ID NO: 11 - protein, 11 aa, Homo sapiens
GDFLAEGGGVR

SEQ ID NO: 12 - protein, 12 aa, Homo sapiens
EDLQLTHNKITK

SEQ ID NO: 13 - protein, 16 aa, Homo sapiens
DALSSVQESQVAQQAR

SEQ ID NO: 14 - protein, 18 aa, Homo sapiens
GWVTDGFSSLKDYWSTVK

SEQ ID NO: 15 - protein, 11 aa, Homo sapiens
ADGSYAAWLSR

SEQ ID NO: 16 - protein, 6 aa, Homo sapiens
EKGYPK

SEQ ID NO: 17 - protein, 13 aa, Homo sapiens
AADDTWEPFASGK

SEQ ID NO: 18 - protein, 7 aa, Homo sapiens
LSQRFPK

SEQ ID NO: 19 - protein, 15 aa, Homo sapiens
YVGGQEHFAHLLILR

SEQ ID NO: 20 - protein, 17 aa, Homo sapiens
EGGLGPLNIPLLADVTR

SEQ ID NO: 21 - protein, 25 aa, Homo sapiens
GRTLEIPGNSDPNMIPDGDFNSYVR

SEQ ID NO: 22 - protein, 18 aa, Homo sapiens
QFTSSTSYNRGDSTFESK

SEQ ID NO: 23 - protein, 16 aa, Homo sapiens
QIRGLEEELQFSLGSK

SEQ ID NO: 24 - protein, 8 aa, Homo sapiens
WVYPPEKK

SEQ ID NO: 25 - protein, 15 aa, Homo sapiens
DFALLSLQVPLKDAK

SEQ ID NO: 26 - protein, 23 aa, Homo sapiens
ALGISPFHEHAEVVFTANDSGPR

SEQ ID NO: 27 - protein, 16 aa, Homo sapiens
RHLVPGAPFLLQALVR

SEQ ID NO: 28 - protein, 16 aa, Homo sapiens
AVDQSVLLMKPDAELS

SEQ ID NO: 29 - protein, 10 aa, Homo sapiens
SDVVYTDWKK

SEQ ID NO: 30 - protein, 8 aa, Homo sapiens
AELQEGAR

SEQ ID NO: 31 - protein, 14 aa, Homo sapiens
YLYHGQTLETLGGK

SEQ ID NO: 32 - protein, 9 aa, Homo sapiens
KPAITYGTR

SEQ ID NO: 33 - protein, 9 aa, Homo sapiens
WFYIASAFR

SEQ ID NO: 34 - protein, 11 aa, Homo sapiens
LKAKLPDATPK

SEQ ID NO: 35 - protein, 12 aa, Homo sapiens
FLVGPDGIPIMR

SEQ ID NO: 36 - protein, 24 aa, Homo sapiens
RYTIAALLSPYSYSTTAVVTNPKE

SEQ ID NO: 37 - protein, 25 aa, Homo sapiens
RIYEDSDADLQLQGFYEEVANPLLT

SEQ ID NO: 38 - protein, 9 aa, Homo sapiens
SVGFHLPSR

SEQ ID NO: 39 - protein, 28 aa, Homo sapiens
TSESGELHGLTTEEEFVEGIYKVEIDTK

SEQ ID NO: 40 - protein, 9 aa, Homo sapiens
AEFQDALEK

SEQ ID NO: 41 - protein, 16 aa, Homo sapiens
YLDKTEQWSTLPPETK

SEQ ID NO: 42 - protein, 12 aa, Homo sapiens
GQIVFMNREPKR

SEQ ID NO: 43 - protein, 10 aa, Homo sapiens
SDVMYTDWKK

SEQ ID NO: 44 - protein, 13 aa, Homo sapiens
EELVYELNPLDHR

SEQ ID NO: 45 - protein, 15 aa, Homo sapiens
SPAGPTVVSIGGGKG

SEQ ID NO: 46 - protein, 13 aa, Homo sapiens
DEMPSPTFLTQVK

SEQ ID NO: 47 - protein, 13 aa, Homo sapiens
GSFEFPVGDAVSK

SEQ ID NO: 48 - protein, 6 aa, Homo sapiens
TPVSDR

SEQ ID NO: 49 - protein, 23 aa, Homo sapiens
TLEIPGNSDPNMIPDGDFNSYVR

SEQ ID NO: 50 - protein, 13 aa, Homo sapiens
GGQEHFAHLLILR

SEQ ID NO: 51 - protein, 10 aa, Homo sapiens
FGLLDEDGKK

SEQ ID NO: 52 - protein, 32 aa, Homo sapiens
NGESVKLHLETDSLALVALGALDTALYAAGSK

SEQ ID NO: 53 - protein, 7 aa, Homo sapiens
FRQELFR

SEQ ID NO: 54 - protein, 16 aa, Homo sapiens
EQLKAVMDDFAAFVEK

SEQ ID NO: 55 - protein, 7 aa, Homo sapiens
LGEYDLR

SEQ ID NO: 56 - protein, 11 aa, Homo sapiens
LGQYASPTAKR

SEQ ID NO: 57 - protein, 13 aa, Homo sapiens
GEGTGYFVDFSVR

SEQ ID NO: 58 - protein, 18 aa, Homo sapiens
ILTVPGHLDEMQLDIQAR

SEQ ID NO: 59 - protein, 14 aa, Homo sapiens
GSPAINVAVHVFRK

SEQ ID NO: 60 - protein, 8 aa, Homo sapiens
TQVLHFTK

SEQ ID NO: 61 - protein, 16 aa, Homo sapiens
GFSLDEATNLNGGLLR

SEQ ID NO: 62 - protein, 26 aa, Homo sapiens
LHLETDSLALVALGALDTALYAAGSK

SEQ ID NO: 63 - protein, 21 aa, Homo sapiens
TSAHGNVAEGETKPDPDVTER

SEQ ID NO: 64 - protein, 22 aa, Homo sapiens
GISPFHEHAEVVFTANDSGPRR

SEQ ID NO: 65 - protein, 8 aa, Homo sapiens
GQIVFMNR

SEQ ID NO: 66 - protein, 26 aa, Homo sapiens
VTASDPLDTLGSEGALSPGGVASLLR

SEQ ID NO: 67 - protein, 15 aa, Homo sapiens
YEGGREHVAHLLFLR

SEQ ID NO: 68 - protein, 26 aa, Homo sapiens
TPLPPTSAHGNVAEGETKPDPDVTER

SEQ ID NO: 69 - protein, 25 aa, Homo sapiens
STQDTVIALDALSAYWIASHTTEER

SEQ ID NO: 70 - protein, 23 aa, Homo sapiens
YTIAALLSPYSYSTTAVVTNPKE

SEQ ID NO: 71 - protein, 9 aa, Homo sapiens
SHALQLNNR

SEQ ID NO: 72 - protein, 25 aa, Homo sapiens
YLDKTEQWSTLPPETKDHAVDLIQK

SEQ ID NO: 73 - protein, 15 aa, Homo sapiens
VAEGETKPDPDVTER

SEQ ID NO: 74 - protein, 7 aa, Homo sapiens
VEASISK

SEQ ID NO: 75 - protein, 19 aa, Homo sapiens
NYAEAKDVFLGMFLYEYAR

SEQ ID NO: 76 - protein, 11 aa, Homo sapiens
GQIVFMNREPK

SEQ ID NO: 77 - protein, 17 aa, Homo sapiens
SEAEDASLLSFMQGYMK

SEQ ID NO: 78 - protein, 15 aa, Homo sapiens
NLIAAVAPGAFLGLK

SEQ ID NO: 79 - protein, 15 aa, Homo sapiens
VLSLAQEQVGGSPEK

SEQ ID NO: 80 - protein, 19 aa, Homo sapiens
ALEILQEEDLIDEDDIPVR

SEQ ID NO: 81 - protein, 12 aa, Homo sapiens
LNMGITDLQGLR

SEQ ID NO: 82 - protein, 17 aa, Homo sapiens
MSLDYGFVTPLTSMSIR

SEQ ID NO: 83 - protein, 16 aa, Homo sapiens
VAGLLEDTFPGLLGLR

SEQ ID NO: 84 - protein, 22 aa, Homo sapiens
SFEGLGQLEVLTLDHNQLQEVK

SEQ ID NO: 85 - protein, 15 aa, Homo sapiens
RHPYFYAPELLFFAK

SEQ ID NO: 86 - protein, 9 aa, Homo sapiens
DHAVDLIQK

SEQ ID NO: 87 - protein, 13 aa, Homo sapiens
NGFKSHALQLNNR

SEQ ID NO: 88 - protein, 23 aa, Homo sapiens
YVSHFETEGPHVLLYFDSVPTSR

SEQ ID NO: 89 - protein, 42 aa, Homo sapiens
LRLEPGKEYLIMGLDGATYDLEGHPQYLLDSNSWIEEMPSER

SEQ ID NO: 90 - protein, 23 aa, Homo sapiens
PPTSAHGNVAEGETKPDPDVTER

SEQ ID NO: 91 - protein, 14 aa, Homo sapiens
EWFWDLATGTMKER

SEQ ID NO: 92 - protein, 9 aa, Homo sapiens
LELSVDGAK

SEQ ID NO: 93 - protein, 9 aa, Homo sapiens
TPVSDRVTK

SEQ ID NO: 94 - protein, 9 aa, Homo sapiens
FKKPQSLTK

SEQ ID NO: 95 - protein, 12 aa, Homo sapiens
AVMDDFAAFVEK

SEQ ID NO: 96 - protein, 8 aa, Homo sapiens
TYETTLEK

SEQ ID NO: 97 - protein, 12 aa, Homo sapiens
KADGSYAAWLSR

SEQ ID NO: 98 - protein, 30 aa, Homo sapiens
LTSLSDRYVSHFETEGPHVLLYFDSVPTSR

SEQ ID NO: 99 - protein, 7 aa, Homo sapiens
GLESQTK

SEQ ID NO: 100 - protein, 18 aa, Homo sapiens
AVGSGATFSHYYYMILSR

SEQ ID NO: 101 - protein, 12 aa, Homo sapiens
YGKPVQGVAYVR

SEQ ID NO: 102 - protein, 13 aa, Homo sapiens
IIPHHNYNAAINK

SEQ ID NO: 103 - protein, 18 aa, Homo sapiens
GSWVNKFPVEMTHNHNFR

SEQ ID NO: 104 - protein, 14 aa, Homo sapiens
LDELRDEGKASSAK

SEQ ID NO: 105 - protein, 20 aa, Homo sapiens
AYSLFSYNTQGRDNELLVYK

SEQ ID NO: 106 - protein, 27 aa, Homo sapiens
TLMFGSYLDDEKNWGLSFYADKPETTK

SEQ ID NO: 107 - protein, 35 aa, Homo sapiens
ADLEKLTSLSDRYVSHFETEGPHVLLYFDSVPTSR

SEQ ID NO: 108 - protein, 9 aa, Homo sapiens
YVLPNFEVK

SEQ ID NO: 109 - protein, 7 aa, Homo sapiens
VSMMQTK

SEQ ID NO: 110 - protein, 19 aa, Homo sapiens
AHGNVAEGETKPDPDVTER

SEQ ID NO: 111 - protein, 10 aa, Homo sapiens
NQFNDYTSKK

SEQ ID NO: 112 - protein, 10 aa, Homo sapiens
SVPMVPPGIK

SEQ ID NO: 113 - protein, 26 aa, Homo sapiens
VGLSGMAIADVTLLSGFHALRADLEK

SEQ ID NO: 114 - protein, 14 aa, Homo sapiens
KAADDTWEPFASGK

SEQ ID NO: 115 - protein, 9 aa, Homo sapiens
VDFTLSSER

SEQ ID NO: 116 - protein, 20 aa, Homo sapiens
SVNDLYIQKQFPILLDFKTK

SEQ ID NO: 117 - protein, 17 aa, Homo sapiens
ALVAIDYINQNLPWGYK

SEQ ID NO: 118 - protein, 16 aa, Homo sapiens
LAYLQPALFSGLAELR

SEQ ID NO: 119 - protein, 18 aa, Homo sapiens
SVFLIKGDKVWVYPPEKK

SEQ ID NO: 120 - protein, 17 aa, Homo sapiens
GHLFLQTDQPIYNPGQR

SEQ ID NO: 121 - protein, 20 aa, Homo sapiens
PPSGGPGFLSIERPDSRPPR

SEQ ID NO: 122 - protein, 15 aa, Homo sapiens
LFQGLGKLEYLLLSR

SEQ ID NO: 123 - protein, 8 aa, Homo sapiens
NLPEQVFR

SEQ ID NO: 124 - protein, 7 aa, Homo sapiens
EFHLHLR

SEQ ID NO: 125 - protein, 11 aa, Homo sapiens
TFTPQPPGLER

SEQ ID NO: 126 - protein, 10 aa, Homo sapiens
YLDWIHGHIR

SEQ ID NO: 127 - protein, 15 aa, Homo sapiens
VEASISKANSFLGEK

SEQ ID NO: 128 - protein, 8 aa, Homo sapiens
AEFAEVSK

SEQ ID NO: 129 - protein, 10 aa, Homo sapiens
NIQSLEVIGK

SEQ ID NO: 130 - protein, 17 aa, Homo sapiens
VFDEFKPLVEEPQNLIK

SEQ ID NO: 131 - protein, 25 aa, Homo sapiens
EVYMPSSIFQDDFVIPDISEPGTWK

SEQ ID NO: 132 - protein, 13 aa, Homo sapiens
EGETKPDPDVTER

SEQ ID NO: 133 - protein, 11 aa, Homo sapiens
GLQDEDGYRMK

SEQ ID NO: 134 - protein, 13 aa, Homo sapiens
GLEEELQFSLGSK

SEQ ID NO: 135 - protein, 11 aa, Homo sapiens
PAINVAVHVFR

SEQ ID NO: 136 - protein, 16 aa, Homo sapiens
RHPYFYAPELLFFAKR

SEQ ID NO: 137 - protein, 33 aa, Homo sapiens
LVNGQSHISLSKAEFQDALEKLNMGITDLQGLR

SEQ ID NO: 138 - protein, 13 aa, Homo sapiens
HTDLSGKVFVFPR

SEQ ID NO: 139 - protein, 6 aa, Homo sapiens
NVNFQK

SEQ ID NO: 140 - protein, 15 aa, Homo sapiens
ALRDFALQNPSAVPR

SEQ ID NO: 141 - protein, 14 aa, Homo sapiens
EGGREHVAHLLFLR

SEQ ID NO: 142 - protein, 12 aa, Homo sapiens
LTEVLLGHNSWR

SEQ ID NO: 143 - protein, 11 aa, Homo sapiens
TVMVENSHGLR

SEQ ID NO: 144 - protein, 13 aa, Homo sapiens
AEMADQASAWLTR

SEQ ID NO: 145 - protein, 19 aa, Homo sapiens
GPEVQLVAHSPWLKDSLSR

SEQ ID NO: 146 - protein, 8 aa, Homo sapiens
MFQEIVHK

SEQ ID NO: 147 - protein, 38 aa, Homo sapiens
LFLKDNGLVGIEEQSLWGLAELLELDLTSNQLTHLPHR

SEQ ID NO: 148 - protein, 7 aa, Homo sapiens
AYSDLSR

SEQ ID NO: 149 - protein, 14 aa, Homo sapiens
GPEVQLVAHSPWLK

SEQ ID NO: 150 - protein, 16 aa, Homo sapiens
TMEQFTIHLTVNPQSK

SEQ ID NO: 151 - protein, 27 aa, Homo sapiens
KKEVYMPSSIFQDDFVIPDISEPGTWK

SEQ ID NO: 152 - protein, 14 aa, Homo sapiens
IRPHTFTGLSGLRR

SEQ ID NO: 153 - protein, 9 aa, Homo sapiens
FREFHLHLR

SEQ ID NO: 154 - protein, 9 aa, Homo sapiens
YRVFALDQK

SEQ ID NO: 155 - protein, 18 aa, Homo sapiens
YNPVVIDFEMQPIHEVLR

SEQ ID NO: 156 - protein, 18 aa, Homo sapiens
HGNVAEGETKPDPDVTER

SEQ ID NO: 157 - protein, 17 aa, Homo sapiens
EVQLVAHSPWLKDSLSR

SEQ ID NO: 158 - protein, 20 aa, Homo sapiens
GHGLGHGHEQQHGLGHGHKF

SEQ ID NO: 159 - protein, 10 aa, Homo sapiens
LDAQASFLPK

SEQ ID NO: 160 - protein, 20 aa, Homo sapiens
GATDNKGPVLAWINAVSAFR

SEQ ID NO: 161 - protein, 10 aa, Homo sapiens
EMEDTLNHLK

SEQ ID NO: 162 - protein, 10 aa, Homo sapiens
SFFPENWLWR

SEQ ID NO: 163 - protein, 15 aa, Homo sapiens
AINEKLGQYASPTAK

SEQ ID NO: 164 - protein, 8 aa, Homo sapiens
VEYGFQVK

SEQ ID NO: 165 - protein, 18 aa, Homo sapiens
DKVNSFFSTFKEKESQDK

SEQ ID NO: 166 - protein, 8 aa, Homo sapiens
MKVDREER

SEQ ID NO: 167 - protein, 9 aa, Homo sapiens
EHSSLAFWK

SEQ ID NO: 168 - protein, 6 aa, Homo sapiens
HLMAGR

SEQ ID NO: 169 - protein, 13 aa, Homo sapiens
GSPAINVAVHVFR

SEQ ID NO: 170 - protein, 22 aa, Homo sapiens
TSESGELHGLTTEEEFVEGIYK

SEQ ID NO: 171 - protein, 29 aa, Homo sapiens
GRFPLYNLGFGHNVDFNFLEVMSMENNGR

SEQ ID NO: 172 - protein, 24 aa, Homo sapiens
VDFTLSSERDFALLSLQVPLKDAK

SEQ ID NO: 173 - protein, 22 aa, Homo sapiens
LAYLQPALFSGLAELRELDLSR

SEQ ID NO: 174 - protein, 10 aa, Homo sapiens
KIYEQEGLEK

SEQ ID NO: 175 - protein, 10 aa, Homo sapiens
PKVVEEQESR

SEQ ID NO: 176 - protein, 19 aa, Homo sapiens
ERPGVYTNVVEYVDWILEK

SEQ ID NO: 177 - protein, 9 aa, Homo sapiens
VTYDVSRDK

SEQ ID NO: 178 - protein, 23 aa, Homo sapiens
PGKPYILTVPGHLDEMQLDIQAR

SEQ ID NO: 179 - protein, 14 aa, Homo sapiens
LAELPADALGPLQR

SEQ ID NO: 180 - protein, 10 aa, Homo sapiens
KATVVYQGER

SEQ ID NO: 181 - protein, 17 aa, Homo sapiens
GEWPWQVTLHTTSPTQR

SEQ ID NO: 182 - protein, 7 aa, Homo sapiens
VTYDVSR

SEQ ID NO: 183 - protein, 19 aa, Homo sapiens
GSLVQASEANLQAAQDFVR

SEQ ID NO: 184 - protein, 11 aa, Homo sapiens
QFPILLDFKTK

SEQ ID NO: 185 - protein, 16 aa, Homo sapiens
YQIWTTVVDWIHPDLK

SEQ ID NO: 186 - protein, 22 aa, Homo sapiens
AYSLFSYNTQGRDNELLVYKER

SEQ ID NO: 187 - protein, 17 aa, Homo sapiens
TFKDLHFLEELQLGHNR

SEQ ID NO: 188 - protein, 16 aa, Homo sapiens
VFREFHLHLRLPMSVR

SEQ ID NO: 189 - protein, 12 aa, Homo sapiens
PAINVAVHVFRK

SEQ ID NO: 190 - protein, 14 aa, Homo sapiens
SSTTKPPFKPHGSR

SEQ ID NO: 191 - protein, 28 aa, Homo sapiens
DGWHSWPIAHQWPQGPSAVDAAFSWEEK

SEQ ID NO: 192 - protein, 22 aa, Homo sapiens
QGHNSVFLIKGDKVWVYPPEKK

SEQ ID NO: 193 - protein, 14 aa, Homo sapiens
FGLLDEDGKKTFFR

SEQ ID NO: 194 - protein, 8 aa, Homo sapiens
FPENWLWR

SEQ ID NO: 195 - protein, 8 aa, Homo sapiens
WLDLSHNR

SEQ ID NO: 196 - protein, 6 aa, Homo sapiens
VFVFPR

SEQ ID NO: 197 - protein, 8 aa, Homo sapiens
VVEEQESR

SEQ ID NO: 198 - protein, 21 aa, Homo sapiens
VVGGEDAKPGQFPWQVVLNGK

SEQ ID NO: 199 - protein, 42 aa, Homo sapiens
GIEILNQVQESLPELSNHASILIMLTDGDPTEGVTDRSQILK

SEQ ID NO: 200 - protein, 22 aa, Homo sapiens
PTSAHGNVAEGETKPDPDVTER

SEQ ID NO: 201 - protein, 13 aa, Homo sapiens
VSFLSALEEYTKK

SEQ ID NO: 202 - protein, 8 aa, Homo sapiens
LHIMAGRR

SEQ ID NO: 203 - protein, 17 aa, Homo sapiens
GHYFWMLSPFSPPSPAR

SEQ ID NO: 204 - protein, 6 aa, Homo sapiens
MSGAAR

SEQ ID NO: 205 - protein, 22 aa, Homo sapiens
VANYFDWISYHVGRPFISQYNV

SEQ ID NO: 206 - protein, 11 aa, Homo sapiens
HEALPLAFTQK

SEQ ID NO: 207 - protein, 12 aa, Homo sapiens
ERGHMLENHVER

SEQ ID NO: 208 - protein, 7 aa, Homo sapiens
FHPLHSK

SEQ ID NO: 209 - protein, 12 aa, Homo sapiens
DSSTWLTAFVLK

SEQ ID NO: 210 - protein, 14 aa, Homo sapiens
RGDSPWQVVLLDSK

SEQ ID NO: 211 - protein, 10 aa, Homo sapiens
KYVLPNFEVK

SEQ ID NO: 212 - protein, 24 aa, Homo sapiens
LPPTSAHGNVAEGETKPDPDVTER

SEQ ID NO: 213 - protein, 11 aa, Homo sapiens
SEYGAALAWEK

SEQ ID NO: 214 - protein, 10 aa, Homo sapiens
DNELLVYKER

SEQ ID NO: 215 - protein, 11 aa, Homo sapiens
QLYGDTGVLGR

SEQ ID NO: 216 - protein, 13 aa, Homo sapiens
EMSGSPASGIPVK

SEQ ID NO: 217 - protein, 12 aa, Homo sapiens
LSHNAIASLRPR

SEQ ID NO: 218 - protein, 11 aa, Homo sapiens
GDKVWVYPPEK

SEQ ID NO: 219 - protein, 7 aa, Homo sapiens
TNNHIMK

SEQ ID NO: 220 - protein, 25 aa, Homo sapiens
ITPGKPYILTVPGHLDEMQLDIQAR

SEQ ID NO: 221 - protein, 8 aa, Homo sapiens
MLENHVER

SEQ ID NO: 222 - protein, 9 aa, Homo sapiens
WDRELISER

SEQ ID NO: 223 - protein, 12 aa, Homo sapiens
LVNGQSHISLSK

SEQ ID NO: 224 - protein, 27 aa, Homo sapiens
LQETSNWLLSQQQADGSFQDLSPVIHR

SEQ ID NO: 225 - protein, 21 aa, Homo sapiens
NLELGLTQGSFAFIHKDFDVK

SEQ ID NO: 226 - protein, 7 aa, Homo sapiens
VFALDQK

SEQ ID NO: 227 - protein, 11 aa, Homo sapiens
YSPGGTPTAIK

SEQ ID NO: 228 - protein, 6 aa, Homo sapiens
VLQIEK

SEQ ID NO: 229 - protein, 9 aa, Homo sapiens
SHKPLNMGK

SEQ ID NO: 230 - protein, 14 aa, Homo sapiens
YIYGKPVQGVAYVR

SEQ ID NO: 231 - protein, 21 aa, Homo sapiens
DLRDKVNSFFSTFKEKESQDK

SEQ ID NO: 232 - protein, 19 aa, Homo sapiens
SSPVVIDASTAIDAPSNLR

SEQ ID NO: 233 - protein, 18 aa, Homo sapiens
RGHLFLQTDQPIYNPGQR

SEQ ID NO: 234 - protein, 15 aa, Homo sapiens
VPGTSTSATLTGLTR

SEQ ID NO: 235 - protein, 11 aa, Homo sapiens
PALFSGLAELR

SEQ ID NO: 236 - protein, 13 aa, Homo sapiens
QYYEGSEIVVAGR

SEQ ID NO: 237 - protein, 42 aa, Homo sapiens
VLSLAQEQVGGSPEKLQETSNWLLSQQQADGSFQDLSPVIHR

SEQ ID NO: 238 - protein, 10 aa, Homo sapiens
QGYFVEAQPK

SEQ ID NO: 239 - protein, 22 aa, Homo sapiens
QKLGPHAGDVEGHLSFLEKDLR

SEQ ID NO: 240 - protein, 10 aa, Homo sapiens
GFYFSRPASR

SEQ ID NO: 241 - protein, 7 aa, Homo sapiens
VPPRYPR

SEQ ID NO: 242 - protein, 11 aa, Homo sapiens
TQVLHFTKDVK

SEQ ID NO: 243 - protein, 19 aa, Homo sapiens
MRPSTDTITVMVENSHGLR

SEQ ID NO: 244 - protein, 8 aa, Homo sapiens
FWTSFFPK

SEQ ID NO: 245 - protein, 26 aa, Homo sapiens
LLLFSPSVVHLGVPLSVGVQLQDVPR

SEQ ID NO: 246 - protein, 9 aa, Homo sapiens
LSMDGSPTR

SEQ ID NO: 247 - protein, 10 aa, Homo sapiens
GSVFLRNPSR

SEQ ID NO: 248 - protein, 9 aa, Homo sapiens
QKLHELQEK

SEQ ID NO: 249 - protein, 12 aa, Homo sapiens
TYTSQEDLVEKK

SEQ ID NO: 250 - protein, 15 aa, Homo sapiens
LSEKHEGSFIQGAEK

SEQ ID NO: 251 - protein, 25 aa, Homo sapiens
LTVAAPPSGGPGFLSIERPDSRPPR

SEQ ID NO: 252 - protein, 18 aa, Homo sapiens
SVNDLYIQKQFPILLDFK

SEQ ID NO: 253 - protein, 14 aa, Homo sapiens
GLGSLRELVLAGNR

SEQ ID NO: 254 - protein, 11 aa, Homo sapiens
GEPGDPVNLLR

SEQ ID NO: 255 - protein, 10 aa, Homo sapiens
NHMQYEIVIK

SEQ ID NO: 256 - protein, 11 aa, Homo sapiens
GDSGGPLIVHK

SEQ ID NO: 257 - protein, 16 aa, Homo sapiens
FSEWGNNAFFYYFEHR

SEQ ID NO: 258 - protein, 24 aa, Homo sapiens
FIIEGMEEAGSVALEELVEKEKDR

SEQ ID NO: 259 - protein, 11 aa, Homo sapiens
VQPYLDDFQKK

SEQ ID NO: 260 - protein, 8 aa, Homo sapiens
GSFPWQAK

SEQ ID NO: 261 - protein, 25 aa, Homo sapiens
ISDFAVTADGNAFIGDIKDKVTAWK

SEQ ID NO: 262 - protein, 20 aa, Homo sapiens
TRHTASAWLMSAPNSGPHNR

SEQ ID NO: 263 - protein, 9 aa, Homo sapiens
NYNLVESLK

SEQ ID NO: 264 - protein, 19 aa, Homo sapiens
DLEIEVVLFHPNYNINGKK

SEQ ID NO: 265 - protein, 8 aa, Homo sapiens
DNELLVYK

SEQ ID NO: 266 - protein, 9 aa, Homo sapiens
SVNDLYIQK

SEQ ID NO: 267 - protein, 12 aa, Homo sapiens
EWFWDLATGTMK

SEQ ID NO: 268 - protein, 23 aa, Homo sapiens
IEDANLIPPVPDDKFQDLVDAVR

SEQ ID NO: 269 - protein, 7 aa, Homo sapiens
LHIMAGR

SEQ ID NO: 270 - protein, 18 aa, Homo sapiens
LDDDLEHQGGHVLDHGHK

SEQ ID NO: 271 - protein, 9 aa, Homo sapiens
INVAVHVFR

SEQ ID NO: 272 - protein, 24 aa, Homo sapiens
AFWLDVSHNRLEALPNSLLAPLGR

SEQ ID NO: 273 - protein, 12 aa, Homo sapiens
RLSNENHGIAQR

SEQ ID NO: 274 - protein, 9 aa, Homo sapiens
PFLLQALVR

SEQ ID NO: 275 - protein, 18 aa, Homo sapiens
FAHYVVTSQVVNTANEAR

SEQ ID NO: 276 - protein, 9 aa, Homo sapiens
PVRGEVPPR

SEQ ID NO: 277 - protein, 10 aa, Homo sapiens
VGDTLNLNLR

SEQ ID NO: 278 - protein, 9 aa, Homo sapiens
RHDWGHEKQ

SEQ ID NO: 279 - protein, 11 aa, Homo sapiens
VNGQSHISLSK

SEQ ID NO: 280 - protein, 12 aa, Homo sapiens
ITQVLHFTKDVK

SEQ ID NO: 281 - protein, 7 aa, Homo sapiens
PLAEDVR

SEQ ID NO: 282 - protein, 11 aa, Homo sapiens
FSGTWYAMAKK

SEQ ID NO: 283 - protein, 20 aa, Homo sapiens
GLIKDALENIDPATQMMILN

SEQ ID NO: 284 - protein, 11 aa, Homo sapiens
LNHQLEGLTFQ

SEQ ID NO: 285 - protein, 9 aa, Homo sapiens
QGSFQGGFR

SEQ ID NO: 286 - protein, 8 aa, Homo sapiens
FLQEQGHR

SEQ ID NO: 287 - protein, 10 aa, Homo sapiens
LGQYASPTAK

SEQ ID NO: 288 - protein, 9 aa, Homo sapiens
DIYKGVDMR

SEQ ID NO: 289 - protein, 21 aa, Homo sapiens
VGLSGMAIADVTLLSGFHALR

SEQ ID NO: 290 - protein, 9 aa, Homo sapiens
VVEESELAR

SEQ ID NO: 291 - protein, 28 aa, Homo sapiens
NVKENIQDNISLFSLGMGFDVDYDFLKR

SEQ ID NO: 292 - protein, 20 aa, Homo sapiens
DGSPDVTTADIGANTPDATK

SEQ ID NO: 293 - protein, 36 aa, Homo sapiens
GGASEHITTLAYQELPTADLMQEWGDAVQYNPAIIK

SEQ ID NO: 294 - protein, 18 aa, Homo sapiens
RITEVWGIPSPIDTVFTR

SEQ ID NO: 295 - protein, 19 aa, Homo sapiens
PSGGPGFLSIERPDSRPPR

SEQ ID NO: 296 - protein, 10 aa, Homo sapiens
TAAISGYSFK

SEQ ID NO: 297 - protein, 11 aa, Homo sapiens
PEHVFIHPGWK

SEQ ID NO: 298 - protein, 25 aa, Homo sapiens
ATLLDIYKTGEAVAEKDSEITFIKK

SEQ ID NO: 299 - protein, 10 aa, Homo sapiens
VGEYSLYIGR

SEQ ID NO: 300 - protein, 34 aa, Homo sapiens
DNGLVGIEEQSLWGLAELLELDLTSNQLTHLPHR

SEQ ID NO: 301 - protein, 9 aa, Homo sapiens
GEVPPRYPR

SEQ ID NO: 302 - protein, 16 aa, Homo sapiens
ITGYIIKYEKPGSPPR

SEQ ID NO: 303 - protein, 22 aa, Homo sapiens
FKLDDDLEHQGGHVLDHGHKHK

SEQ ID NO: 304 - protein, 20 aa, Homo sapiens
ITVVAGEHNIEETEHTEQKR

SEQ ID NO: 305 - protein, 14 aa, Homo sapiens
TTNIQGINLLFSSR

SEQ ID NO: 306 - protein, 18 aa, Homo sapiens
WLPSSSPVTGYRVTTTPK

SEQ ID NO: 307 - protein, 8 aa, Homo sapiens
RTPITVVK

SEQ ID NO: 308 - protein, 7 aa, Homo sapiens
SSAYKWK

SEQ ID NO: 309 - protein, 9 aa, Homo sapiens
ITQVLHFTK

SEQ ID NO: 310 - protein, 8 aa, Homo sapiens
LNEREVVK

SEQ ID NO: 311 - protein, 12 aa, Homo sapiens
EAPKVVEEQESR

SEQ ID NO: 312 - protein, 10 aa, Homo sapiens
IADNKQSSFK

SEQ ID NO: 313 - protein, 9 aa, Homo sapiens
GHNSVFLIK

SEQ ID NO: 314 - protein, 31 aa, Homo sapiens
VTIMWTPPESAVTGYRVDVIPVNLPGEHGQR

SEQ ID NO: 315 - protein, 19 aa, Homo sapiens
EGAIHREELVYELNPLDHR

SEQ ID NO: 316 - protein, 39 aa, Homo sapiens
SMQGGLVGNDETVALTAFVTIALHHGLAVFQDEGAEPLK

SEQ ID NO: 317 - protein, 21 aa, Homo sapiens
AEFQDALEKLNMGITDLQGLR

SEQ ID NO: 318 - protein, 20 aa, Homo sapiens
QLVHHFEIDVDIFEPQGISK

SEQ ID NO: 319 - protein, 11 aa, Homo sapiens
VKSPELQAEAK

SEQ ID NO: 320 - protein, 8 aa, Homo sapiens
ELVLAGNR

SEQ ID NO: 321 - protein, 11 aa, Homo sapiens
GSKGPLDQLEK

SEQ ID NO: 322 - protein, 22 aa, Homo sapiens
IIFHENYNAGTYQNDIALIEMK

SEQ ID NO: 323 - protein, 21 aa, Homo sapiens
GGGALLGDRWILTAAHTIYPK

SEQ ID NO: 324 - protein, 12 aa, Homo sapiens
VMDKYTFELSRR

SEQ ID NO: 325 - protein, 11 aa, Homo sapiens
LYYGDDEKYFR

SEQ ID NO: 326 - protein, 20 aa, Homo sapiens
IVEGSDAEIGMSPWQVMLFR

SEQ ID NO: 327 - protein, 10 aa, Homo sapiens
PIKLTQVEHR

SEQ ID NO: 328 - protein, 11 aa, Homo sapiens
SDISGAGGTTT

SEQ ID NO: 329 - protein, 13 aa, Homo sapiens
GLRQGYFVEAQPK

SEQ ID NO: 330 - protein, 10 aa, Homo sapiens
PDISEPGTWK

SEQ ID NO: 331 - protein, 8 aa, Homo sapiens
VVVHPDYR

SEQ ID NO: 332 - protein, 15 aa, Homo sapiens
TTPKDFYVDENTTVR

SEQ ID NO: 333 - protein, 8 aa, Homo sapiens
GLRETLSR

SEQ ID NO: 334 - protein, 9 aa, Homo sapiens
QFPILLDFK

SEQ ID NO: 335 - protein, 24 aa, Homo sapiens
VQSWKGSLVQASEANLQAAQDFVR

SEQ ID NO: 336 - protein, 9 aa, Homo sapiens
YGFYTHVFR

SEQ ID NO: 337 - protein, 25 aa, Homo sapiens
LQVLGPKPALPAGTEDTAKEDAANR

SEQ ID NO: 338 - protein, 33 aa, Homo sapiens
TIVRFNRPFLMIIVPTDTQNIFFMSKVTNPKQA

SEQ ID NO: 339 - protein, 6 aa, Homo sapiens
YGIYTK

SEQ ID NO: 340 - protein, 11 aa, Homo sapiens
LRPDYALLGHR

SEQ ID NO: 341 - protein, 26 aa, Homo sapiens
QRPPDLDTSSNAVDLLFFTDESGDSR

SEQ ID NO: 342 - protein, 20 aa, Homo sapiens
ENADSLQASLRPHADELKAK

SEQ ID NO: 343 - protein, 28 aa, Homo sapiens
TAFISDFAVTADGNAFIGDIKDKVTAWK

SEQ ID NO: 344 - protein, 9 aa, Homo sapiens
PVQGVAYVR

SEQ ID NO: 345 - protein, 13 aa, Homo sapiens
KAAISGENAGLVR

SEQ ID NO: 346 - protein, 22 aa, Homo sapiens
VREYYFAEAQIADFSDPAFISK

SEQ ID NO: 347 - protein, 15 aa, Homo sapiens
ITDLIKDLDSQTMMV

SEQ ID NO: 348 - protein, 11 aa, Homo sapiens
ATEHLSTLSEK

SEQ ID NO: 349 - protein, 10 aa, Homo sapiens
VFREFHLHLR

SEQ ID NO: 350 - protein, 8 aa, Homo sapiens
VQSTITSR

SEQ ID NO: 351 - protein, 13 aa, Homo sapiens
LWAYLTIQELLAK

SEQ ID NO: 352 - protein, 9 aa, Homo sapiens
MVENSHGLR

SEQ ID NO: 353 - protein, 10 aa, Homo sapiens
MDDFAAFVEK

SEQ ID NO: 354 - protein, 9 aa, Homo sapiens
ELAAQTIKK

SEQ ID NO: 355 - protein, 9 aa, Homo sapiens
WNNYMMDWK

SEQ ID NO: 356 - protein, 41 aa, Homo sapiens
SMQGGLVGNDETVALTAFVTIALHHGLAVFQDEGAEPLKQR

SEQ ID NO: 357 - protein, 28 aa, Homo sapiens
GMADQDGLKPTIDKPSEDSPPLEMLGPR

SEQ ID NO: 358 - protein, 19 aa, Homo sapiens
ILGDMQPGDYFDLVLFGTR

SEQ ID NO: 359 - protein, 39 aa, Homo sapiens
HPNSPLDEENLTQENQDRGTHVDLGLASANVDFAFSLYK

SEQ ID NO: 360 - protein, 21 aa, Homo sapiens
LMISDSHISAVAPGTFSDLIK

SEQ ID NO: 361 - protein, 14 aa, Homo sapiens
SPSQSLPASHAHLR

SEQ ID NO: 362 - protein, 10 aa, Homo sapiens
KQHIEAIDVR

SEQ ID NO: 363 - protein, 9 aa, Homo sapiens
VWVYPPEKK

SEQ ID NO: 364 - protein, 7 aa, Homo sapiens
PENWLWR

SEQ ID NO: 365 - protein, 27 aa, Homo sapiens
YKATLLDIYKTGEAVAEKDSEITFIKK

SEQ ID NO: 366 - protein, 9 aa, Homo sapiens
YTLVSGYPK

SEQ ID NO: 367 - protein, 11 aa, Homo sapiens
DKVWVYPPEKK

SEQ ID NO: 368 - protein, 26 aa, Homo sapiens
HIDREFVVMFSVVDENFSWYLEDNIK

SEQ ID NO: 369 - protein, 9 aa, Homo sapiens
ATVVYQGER

SEQ ID NO: 370 - protein, 12 aa, Homo sapiens
MLQITNTGFEMK

SEQ ID NO: 371 - protein, 13 aa, Homo sapiens
VDRPFLFLIYEHR

SEQ ID NO: 372 - protein, 33 aa, Homo sapiens
NVQFNYPHTSVTDVTQNNFHNYFGGSEIVVAGK

SEQ ID NO: 373 - protein, 20 aa, Homo sapiens
RLEKEVGTPHGIILDSVDAA

SEQ ID NO: 374 - protein, 11 aa, Homo sapiens
VNSFFSTFKEK

SEQ ID NO: 375 - protein, 12 aa, Homo sapiens
VSEGNHDIALIK

SEQ ID NO: 376 - protein, 11 aa, Homo sapiens
PHHNYNAAINK

SEQ ID NO: 377 - protein, 12 aa, Homo sapiens
TPEHVFIHPGWK

SEQ ID NO: 378 - protein, 12 aa, Homo sapiens
DAQYAPGYDKVK

SEQ ID NO: 379 - protein, 14 aa, Homo sapiens
NALWHTGNTPGQVR

SEQ ID NO: 380 - protein, 8 aa, Homo sapiens
QLTPYAQR

SEQ ID NO: 381 - protein, 23 aa, Homo sapiens
KYNPIPSVQLMGNGFHFLAGEPR

SEQ ID NO: 382 - protein, 14 aa, Homo sapiens
YQYNTDVVFDSQGK

SEQ ID NO: 383 - protein, 10 aa, Homo sapiens
YLTLNTESTR

SEQ ID NO: 384 - protein, 10 aa, Homo sapiens
FPSPVDAAFR

SEQ ID NO: 385 - protein, 8 aa, Homo sapiens
PTLSQQQK

SEQ ID NO: 386 - protein, 18 aa, Homo sapiens
DFEQPFINKPDTLLVNRK

SEQ ID NO: 387 - protein, 8 aa, Homo sapiens
LPVAPLRK

SEQ ID NO: 388 - protein, 12 aa, Homo sapiens
FFAPDNLDPIPK

SEQ ID NO: 389 - protein, 30 aa, Homo sapiens
HQGTITVNEEGTQATTVTTVGFMPLSTQVR

SEQ ID NO: 390 - protein, 13 aa, Homo sapiens
IRPHTFTGLSGLR

SEQ ID NO: 391 - protein, 17 aa, Homo sapiens
VTGWGNLKETWTANVGK

SEQ ID NO: 392 - protein, 17 aa, Homo sapiens
SNALDIIFQTDLTGQKK

SEQ ID NO: 393 - protein, 11 aa, Homo sapiens
GGYTLVSGYPK

SEQ ID NO: 394 - protein, 15 aa, Homo sapiens
NFRTEHYEEQIEAFK

SEQ ID NO: 395 - protein, 14 aa, Homo sapiens
SRLDTLAQEVALLK

SEQ ID NO: 396 - protein, 10 aa, Homo sapiens
EVAFDLEIPK

SEQ ID NO: 397 - protein, 40 aa, Homo sapiens
LEPGKEYLIMGLDGATYDLEGHPQYLLDSNSWIEEMPSER

SEQ ID NO: 398 - protein, 16 aa, Homo sapiens
MLFDKNGNMAGISDQR

SEQ ID NO: 399 - protein, 11 aa, Homo sapiens
ENLDRDIALMK

SEQ ID NO: 400 - protein, 15 aa, Homo sapiens
VLGQEQDSYGGKFDR

SEQ ID NO: 401 - protein, 10 aa, Homo sapiens
TEVNVLPGAK

SEQ ID NO: 402 - protein, 16 aa, Homo sapiens
SNALDIIFQTDLTGQK

SEQ ID NO: 403 - protein, 16 aa, Homo sapiens
DLRDKVNSFFSTFKEK

SEQ ID NO: 404 - protein, 10 aa, Homo sapiens
SLAPTAAAKR

SEQ ID NO: 405 - protein, 13 aa, Homo sapiens
PEVQLVAHSPWLK

SEQ ID NO: 406 - protein, 9 aa, Homo sapiens
RQLTPYAQR

SEQ ID NO: 407 - protein, 7 aa, Homo sapiens
AWFLESK

SEQ ID NO: 408 - protein, 30 aa, Homo sapiens
SSMSPTTNVLLSPLSVATALSALSLGAEQR

SEQ ID NO: 409 - protein, 10 aa, Homo sapiens
TGAVSGHSLK

SEQ ID NO: 410 - protein, 24 aa, Homo sapiens
HRQGPVNLLSDPEQGVEVTGQYER

SEQ ID NO: 411 - protein, 11 aa, Homo sapiens
AINVAVHVFRK

SEQ ID NO: 412 - protein, 9 aa, Homo sapiens
SALVLQYLR

SEQ ID NO: 413 - protein, 16 aa, Homo sapiens
ADLFYDVEALDLESPK

SEQ ID NO: 414 - protein, 9 aa, Homo sapiens
GYGNSDYKR

SEQ ID NO: 415 - protein, 21 aa, Homo sapiens
APPSGGPGFLSIERPDSRPPR

SEQ ID NO: 416 - protein, 25 aa, Homo sapiens
YHFEALADTGISSEFYDNANDLLSK

SEQ ID NO: 417 - protein, 18 aa, Homo sapiens
TLDEFTIIQNLQPQYQFR

SEQ ID NO: 418 - protein, 16 aa, Homo sapiens
VTIMWTPPESAVTGYR

SEQ ID NO: 419 - protein, 22 aa, Homo sapiens
SLALGTFAHTPALASLGLSNNR

SEQ ID NO: 420 - protein, 11 aa, Homo sapiens
EKGEIQNILQK

SEQ ID NO: 421 - protein, 14 aa, Homo sapiens
GSEAINAPGDNPAK

SEQ ID NO: 422 - protein, 9 aa, Homo sapiens
YGDDEKYFR

SEQ ID NO: 423 - protein, 9 aa, Homo sapiens
GRQYLIMGK

SEQ ID NO: 424 - protein, 8 aa, Homo sapiens
HADPDFTR

SEQ ID NO: 425 - protein, 15 aa, Homo sapiens
LYLVQGTQVYVFLTK

SEQ ID NO: 426 - protein, 8 aa, Homo sapiens
GPLDQLEK

SEQ ID NO: 427 - protein, 40 aa, Homo sapiens
AGFEWNEDGAGTTPSPGLQPAHLTFPLDYHLNQPFIFVLR

SEQ ID NO: 428 - protein, 17 aa, Homo sapiens
GFGGLTGQIVAALSTAK

SEQ ID NO: 429 - protein, 12 aa, Homo sapiens
TNAENEFVTIKK

SEQ ID NO: 430 - protein, 13 aa, Homo sapiens
QVTQSYWDTNPTR

SEQ ID NO: 431 - protein, 15 aa, Homo sapiens
LPLEYSYGEYRDLFR

SEQ ID NO: 432 - protein, 16 aa, Homo sapiens
DSQEEEKTEALTSAKR

SEQ ID NO: 433 - protein, 19 aa, Homo sapiens
YPSLSIHGIEGAFDEPGTK

SEQ ID NO: 434 - protein, 24 aa, Homo sapiens
ATLLDIYKTGEAVAEKDSEITFIK

SEQ ID NO: 435 - protein, 9 aa, Homo sapiens
SDLEVAHYK

SEQ ID NO: 436 - protein, 29 aa, Homo sapiens
FLQEQGHRAEATTLHVAPQGTAMAVSTFR

SEQ ID NO: 437 - protein, 14 aa, Homo sapiens
MLTPEHVFIHPGWK

SEQ ID NO: 438 - protein, 11 aa, Homo sapiens
GYVIIKPLVWV

SEQ ID NO: 439 - protein, 7 aa, Homo sapiens
KVGSQYR

SEQ ID NO: 440 - protein, 11 aa, Homo sapiens
IFFPGVSEFGK

SEQ ID NO: 441 - protein, 12 aa, Homo sapiens
AAISGENAGLVR

SEQ ID NO: 442 - protein, 6 aa, Homo sapiens
FYLSKK

SEQ ID NO: 443 - protein, 9 aa, Homo sapiens
GSEMVVAGK

SEQ ID NO: 444 - protein, 26 aa, Homo sapiens
KEVYMPSSIFQDDFVIPDISEPGTWK

SEQ ID NO: 445 - protein, 14 aa, Homo sapiens
LGQEQDSYGGKFDR

SEQ ID NO: 446 - protein, 19 aa, Homo sapiens
ETAVDGELVVLYDVKREEK

SEQ ID NO: 447 - protein, 9 aa, Homo sapiens
VNSFFSTFK

SEQ ID NO: 448 - protein, 14 aa, Homo sapiens
YISGMAPRPSLAKK

SEQ ID NO: 449 - protein, 22 aa, Homo sapiens
SGLLGYVSGFGMEMGWLTTELK

SEQ ID NO: 450 - protein, 13 aa, Homo sapiens
QAVDTAVDGVFIR

SEQ ID NO: 451 - protein, 8 aa, Homo sapiens
QLEWGLER

SEQ ID NO: 452 - protein, 16 aa, Homo sapiens
NILFVIDVSGSMWGVK

SEQ ID NO: 453 - protein, 13 aa, Homo sapiens
AIEDYINEFSVRK

SEQ ID NO: 454 - protein, 7 aa, Homo sapiens
VLTGNPR

SEQ ID NO: 455 - protein, 14 aa, Homo sapiens
LWAYLTIQELLAKR

SEQ ID NO: 456 - protein, 25 aa, Homo sapiens
VLQIEKEGAIHREELVYELNPLDHR

SEQ ID NO: 457 - protein, 13 aa, Homo sapiens
GQEQDSYGGKFDR

SEQ ID NO: 458 - protein, 15 aa, Homo sapiens
MGNFPWQVFTNIHGR

SEQ ID NO: 459 - protein, 7 aa, Homo sapiens
LGSYEHR

SEQ ID NO: 460 - protein, 14 aa, Homo sapiens
DSPVLIDFFEDTER

SEQ ID NO: 461 - protein, 9 aa, Homo sapiens
GGPLIVHKR

SEQ ID NO: 462 - protein, 8 aa, Homo sapiens
ASYGVKPR

SEQ ID NO: 463 - protein, 15 aa, Homo sapiens
LNEREVVKVSMMQTK

SEQ ID NO: 464 - protein, 13 aa, Homo sapiens
EDFTSLSLVLYSR

SEQ ID NO: 465 - protein, 10 aa, Homo sapiens
AFWLDVSHNR

SEQ ID NO: 466 - protein, 14 aa, Homo sapiens
LWAYLTINQLLAER

SEQ ID NO: 467 - protein, 13 aa, Homo sapiens
IYGKPVQGVAYVR

SEQ ID NO: 468 - protein, 23 aa, Homo sapiens
GKWLTPFDPVFTEVDTFHLDKYK

SEQ ID NO: 469 - protein, 13 aa, Homo sapiens
DKVNSFFSTFKEK

SEQ ID NO: 470 - protein, 14 aa, Homo sapiens
DLHFLEELQLGHNR

SEQ ID NO: 471 - protein, 32 aa, Homo sapiens
EGKEYGVVLAPDGSTVAVEPLLAGLEAGLQGR

SEQ ID NO: 472 - protein, 9 aa, Homo sapiens
YSRLPVAPR

SEQ ID NO: 473 - protein, 22 aa, Homo sapiens
EAVEHLQKSELTQQLNALFQDK

SEQ ID NO: 474 - protein, 26 aa, Homo sapiens
HRQGPVNLLSDPEQGVEVTGQYEREK

SEQ ID NO: 475 - protein, 8 aa, Homo sapiens
PIYNPGQR

SEQ ID NO: 476 - protein, 21 aa, Homo sapiens
YIPYTLYSVFNPSDHDLVLIR

SEQ ID NO: 477 - protein, 23 aa, Homo sapiens
NRIPESGGDNSVFDIFELTGAAR

SEQ ID NO: 478 - protein, 17 aa, Homo sapiens
VIKVDKDTATLSWGLPK

SEQ ID NO: 479 - protein, 17 aa, Homo sapiens
KEAGIPEFYDYDVALIK

SEQ ID NO: 480 - protein, 19 aa, Homo sapiens
AKFYPEDVSEELIQDITQR

SEQ ID NO: 481 - protein, 29 aa, Homo sapiens
NLAVSQVVHKAVLDVFEEGTEASAATAVK

SEQ ID NO: 482 - protein, 16 aa, Homo sapiens
GGSIQQYIYKQEPVQK

SEQ ID NO: 483 - protein, 29 aa, Homo sapiens
REEKAGELEVFNGYFVHFFAPDNLDPIPK

SEQ ID NO: 484 - protein, 21 aa, Homo sapiens
VDFTLSSERDFALLSLQVPLK

SEQ ID NO: 485 - protein, 20 aa, Homo sapiens
FLHVPDTFEGHFDGVPVISK

SEQ ID NO: 486 - protein, 15 aa, Homo sapiens
SLPVSDSVLSGFEQR

SEQ ID NO: 487 - protein, 10 aa, Homo sapiens
NADYSYSVWK

SEQ ID NO: 488 - protein, 12 aa, Homo sapiens
DTMVEDLVVLVR

SEQ ID NO: 489 - protein, 9 aa, Homo sapiens
NENHGIAQR

SEQ ID NO: 490 - protein, 8 aa, Homo sapiens
FFSAQTNR

SEQ ID NO: 491 - protein, 26 aa, Homo sapiens
VGDRNTEQEEGGEAVHEVEVVIKHNR

SEQ ID NO: 492 - protein, 10 aa, Homo sapiens
DKHADPDFTR

SEQ ID NO: 493 - protein, 17 aa, Homo sapiens
DNLQHKDSSVPNTGTAR

SEQ ID NO: 494 - protein, 16 aa, Homo sapiens
IVLGQEQDSYGGKFDR

SEQ ID NO: 495 - protein, 15 aa, Homo sapiens
IGSGRSSPVTVNQTD

SEQ ID NO: 496 - protein, 21 aa, Homo sapiens
NRPFLMIIVPTDTQNIFFMSK

SEQ ID NO: 497 - protein, 8 aa, Homo sapiens
WLDVSHNR

SEQ ID NO: 498 - protein, 11 aa, Homo sapiens
ELLDTVTAPQK

SEQ ID NO: 499 - protein, 9 aa, Homo sapiens
FGLLDEDGK

SEQ ID NO: 500 - protein, 22 aa, Homo sapiens
LGPHAGDVEGHLSFLEKDLRDK

SEQ ID NO: 501 - protein, 15 aa, Homo sapiens
YNWRENLDRDIALMK

SEQ ID NO: 502 - protein, 18 aa, Homo sapiens
DLEIEVVLFHPNYNINGK

SEQ ID NO: 503 - protein, 13 aa, Homo sapiens
VTFQLTYEEVLKR

SEQ ID NO: 504 - protein, 25 aa, Homo sapiens
QNGAALTSASILAQQVWGTLVLLQR

SEQ ID NO: 505 - protein, 31 aa, Homo sapiens
TIVRFNRPFLMIIVPTDTQNIFFMSKVTNPK

SEQ ID NO: 506 - protein, 12 aa, Homo sapiens
PVRGEVPPRYPR

SEQ ID NO: 507 - protein, 27 aa, Homo sapiens
EYANQFMWEYSTNYGQAPLSLLVSYTK

SEQ ID NO: 508 - protein, 12 aa, Homo sapiens
RPASPISTIQPK

SEQ ID NO: 509 - protein, 14 aa, Homo sapiens
QASLRPHADELKAK

SEQ ID NO: 510 - protein, 10 aa, Homo sapiens
YYGDDEKYFR

SEQ ID NO: 511 - protein, 14 aa, Homo sapiens
FKLEKNYNLVESLK

SEQ ID NO: 512 - protein, 14 aa, Homo sapiens
LEALPNSLLAPLGR

SEQ ID NO: 513 - protein, 6 aa, Homo sapiens
YISQMK

SEQ ID NO: 514 - protein, 6 aa, Homo sapiens
KENFDK

SEQ ID NO: 515 - protein, 13 aa, Homo sapiens
LTPEHVFIHPGWK

SEQ ID NO: 516 - protein, 15 aa, Homo sapiens
MEEVEAMLLPETLKR

SEQ ID NO: 517 - protein, 21 aa, Homo sapiens
GISPFHEHAEVVFTANDSGPR

SEQ ID NO: 518 - protein, 9 aa, Homo sapiens
TLEAQLTPR

SEQ ID NO: 519 - protein, 21 aa, Homo sapiens
LFHTNFYDTVGTIQLINDHVK

SEQ ID NO: 520 - protein, 8 aa, Homo sapiens
FRLPEISR

SEQ ID NO: 521 - protein, 11 aa, Homo sapiens
RNHMQYEIVIK

SEQ ID NO: 522 - protein, 19 aa, Homo sapiens
GPHAGDVEGHLSFLEKDLR

SEQ ID NO: 523 - protein, 21 aa, Homo sapiens
GGGALLGDRWILTAAHTLYPK

SEQ ID NO: 524 - protein, 11 aa, Homo sapiens
PLAEDVRGNLR

SEQ ID NO: 525 - protein, 19 aa, Homo sapiens
SEYGAALAWEKGSSGLEEK

SEQ ID NO: 526 - protein, 15 aa, Homo sapiens
HLVPGAPFLLQALVR

SEQ ID NO: 527 - protein, 14 aa, Homo sapiens
DLRDKVNSFFSTFK

SEQ ID NO: 528 - protein, 18 aa, Homo sapiens
SKSKDHEELSLVASEAVR

SEQ ID NO: 529 - protein, 29 aa, Homo sapiens
YYYDGKDYIEFNKEIPAWVPFDPAAQITK

SEQ ID NO: 530 - protein, 29 aa, Homo sapiens
DQFNLIVFSTEATQWRPSLVPASAENVNK

SEQ ID NO: 531 - protein, 28 aa, Homo sapiens
ITTGGDVINNGLWNMVSVEELEHSISIK

SEQ ID NO: 532 - protein, 18 aa, Homo sapiens
GGETAQSADPQWEQLNNK

SEQ ID NO: 533 - protein, 23 aa, Homo sapiens
IIFHENYNAGTYQNDIALIEMKK

SEQ ID NO: 534 - protein, 15 aa, Homo sapiens
GTVSGTLIGLEFIRK

SEQ ID NO: 535 - protein, 9 aa, Homo sapiens
REQPGVYTK

SEQ ID NO: 536 - protein, 9 aa, Homo sapiens
PSPVDAAFR

SEQ ID NO: 537 - protein, 10 aa, Homo sapiens
DQNVEELKGR

SEQ ID NO: 538 - protein, 15 aa, Homo sapiens
EALIQFLEQVHQGIK

SEQ ID NO: 539 - protein, 24 aa, Homo sapiens
FQILTLWLPDSLTTWEIHGLSLSK

SEQ ID NO: 540 - protein, 14 aa, Homo sapiens
SELTQQLNALFQDK

SEQ ID NO: 541 - protein, 11 aa, Homo sapiens
YGQPLPGYTTK

SEQ ID NO: 542 - protein, 28 aa, Homo sapiens
EEKAGELEVFNGYFVHFFAPDNLDPIPK

SEQ ID NO: 543 - protein, 9 aa, Homo sapiens
SLAPTAAAK

SEQ ID NO: 544 - protein, 29 aa, Homo sapiens
FINDYGTHYITSGSMGGIYEYILVIDKAK

SEQ ID NO: 545 - protein, 6 aa, Homo sapiens
YPPEKK

SEQ ID NO: 546 - protein, 26 aa, Homo sapiens
FPGAVDGATYILVMVDPDAPSRAEPR

SEQ ID NO: 547 - protein, 9 aa, Homo sapiens
MKQTVEAMK

SEQ ID NO: 548 - protein, 19 aa, Homo sapiens
SSNNPHSPIVEEFQVPYNK

SEQ ID NO: 549 - protein, 9 aa, Homo sapiens
MATTMIQSK

SEQ ID NO: 550 - protein, 28 aa, Homo sapiens
KDDIMLDEGMLQSLMELPDQYNYGMYAK

SEQ ID NO: 551 - protein, 20 aa, Homo sapiens
GEVLPLPEANFPSFPLPHHK

SEQ ID NO: 552 - protein, 13 aa, Homo sapiens
EKAGFSWIEVTFK

SEQ ID NO: 553 - protein, 14 aa, Homo sapiens
ITGKPIKLTQVEHR

SEQ ID NO: 554 - protein, 17 aa, Homo sapiens
KFSEWGNNAFFYYFEHR

SEQ ID NO: 555 - protein, 10 aa, Homo sapiens
EVFGQFNGKR

SEQ ID NO: 556 - protein, 24 aa, Homo sapiens
QEALELMNQNLDIYEQQVMTAAQK

SEQ ID NO: 557 - protein, 20 aa, Homo sapiens
SIAPGAFDRLPNLSSLTLSR

SEQ ID NO: 558 - protein, 16 aa, Homo sapiens
APEAQVSVQPNFQQDK

SEQ ID NO: 559 - protein, 20 aa, Homo sapiens
QLGLPGPPDVPDHAAYHPFR

SEQ ID NO: 560 - protein, 8 aa, Homo sapiens
AVASFLRR

SEQ ID NO: 561 - protein, 19 aa, Homo sapiens
EEEHLGILGPQLHADVGDK

SEQ ID NO: 562 - protein, 15 aa, Homo sapiens
FTVDRPFLFLIYEHR

SEQ ID NO: 563 - protein, 10 aa, Homo sapiens
NNANGVDLNR

SEQ ID NO: 564 - protein, 10 aa, Homo sapiens
TVQAVLTVPK

SEQ ID NO: 565 - protein, 8 aa, Homo sapiens
EQPGVYTK

SEQ ID NO: 566 - protein, 21 aa, Homo sapiens
AILQSGSFNAPWAVTSLYEAR

SEQ ID NO: 567 - protein, 11 aa, Homo sapiens
EDWKQDSQLQK

SEQ ID NO: 568 - protein, 9 aa, Homo sapiens
MESLGITSR

SEQ ID NO: 569 - protein, 10 aa, Homo sapiens
QFELHYQEVK

SEQ ID NO: 570 - protein, 14 aa, Homo sapiens
TVDRPFLFLIYEHR

SEQ ID NO: 571 - protein, 11 aa, Homo sapiens
IKSSFVAPLEK

SEQ ID NO: 572 - protein, 19 aa, Homo sapiens
DSEKLKEEIGKELEELRAR

SEQ ID NO: 573 - protein, 9 aa, Homo sapiens
GGISGYTLR

SEQ ID NO: 574 - protein, 27 aa, Homo sapiens
EDYLDVYVFGVGPLVNQVNINALASKK

SEQ ID NO: 575 - protein, 13 aa, Homo sapiens
TSAGTRQPQFISR

SEQ ID NO: 576 - protein, 17 aa, Homo sapiens
FQGDREWFWDLATGTMK

SEQ ID NO: 577 - protein, 10 aa, Homo sapiens
GTRQPQFISR

SEQ ID NO: 578 - protein, 13 aa, Homo sapiens
AHVSFKPTVAQQR

SEQ ID NO: 579 - protein, 11 aa, Homo sapiens
SGYFLSISDSK

SEQ ID NO: 580 - protein, 13 aa, Homo sapiens
QGASGIKEIIQEK

SEQ ID NO: 581 - protein, 22 aa, Homo sapiens
TPEPRPSLSHLLSQYYGAGVAR

SEQ ID NO: 582 - protein, 13 aa, Homo sapiens
EIEEVLTPEMLMR

SEQ ID NO: 583 - protein, 23 aa, Homo sapiens
NILDRQDPPSVVVTSHQAPGEKK

SEQ ID NO: 584 - protein, 24 aa, Homo sapiens
PLLVDVDLQYPQDAVLALTQNHHK

SEQ ID NO: 585 - protein, 19 aa, Homo sapiens
YSHYNERDEIPHNDIALLK

SEQ ID NO: 586 - protein, 15 aa, Homo sapiens
QKISEGLPALEFPNE

SEQ ID NO: 587 - protein, 8 aa, Homo sapiens
KSLSSMTR

SEQ ID NO: 588 - protein, 30 aa, Homo sapiens
KNPREDYLDVYVFGVGPLVNQVNINALASK

SEQ ID NO: 589 - protein, 10 aa, Homo sapiens
EAQLPVIENK

SEQ ID NO: 590 - protein, 15 aa, Homo sapiens
GWHWVGAHTLGHNSR

SEQ ID NO: 591 - protein, 19 aa, Homo sapiens
KSLEDKTERELLESYIDGR

SEQ ID NO: 592 - protein, 10 aa, Homo sapiens
QSTNAYPDLR

SEQ ID NO: 593 - protein, 10 aa, Homo sapiens
SNENHGIAQR

SEQ ID NO: 594 - protein, 17 aa, Homo sapiens
KNQGILEFYGDDIALLK

SEQ ID NO: 595 - protein, 21 aa, Homo sapiens
IVEGSDAEIGMSPWQVMLFRK

SEQ ID NO: 596 - protein, 7 aa, Homo sapiens
ATELHER

SEQ ID NO: 597 - protein, 17 aa, Homo sapiens
GQESSTDIKAPEGFAVR

SEQ ID NO: 598 - protein, 13 aa, Homo sapiens
QGHNSVFLIKGDK

SEQ ID NO: 599 - protein, 8 aa, Homo sapiens
KLGSYEHR

SEQ ID NO: 600 - protein, 16 aa, Homo sapiens
VLNYVDWIKKEMEEED

SEQ ID NO: 601 - protein, 12 aa, Homo sapiens
ERVGEYSLYIGR

SEQ ID NO: 602 - protein, 12 aa, Homo sapiens
DGKYGFYTHVFR

SEQ ID NO: 603 - protein, 13 aa, Homo sapiens
KGTDYHKQPWQAK

SEQ ID NO: 604 - protein, 17 aa, Homo sapiens
ALYYDLISSPDIHGTYK

SEQ ID NO: 605 - protein, 23 aa, Homo sapiens
EPTMYGEILSPNYPQAYPSEVEK

SEQ ID NO: 606 - protein, 14 aa, Homo sapiens
FTKETYDFDIAVLR

SEQ ID NO: 607 - protein, 19 aa, Homo sapiens
VVNNSPQPQNVVFDVQIPK

SEQ ID NO: 608 - protein, 15 aa, Homo sapiens
HLDSVLQQLQTEVYR

SEQ ID NO: 609 - protein, 26 aa, Homo sapiens
MVETTAYALLTSLNLKDINYVNPVIK

SEQ ID NO: 610 - protein, 20 aa, Homo sapiens
AYISMHSYSQHIVFPYSYTR

SEQ ID NO: 611 - protein, 33 aa, Homo sapiens
DTDRFSSHVGGTLGQFYQEVLWGSPAASDDGRR

SEQ ID NO: 612 - protein, 17 aa, Homo sapiens
EIPDEISILLLGVAHFK

SEQ ID NO: 613 - protein, 14 aa, Homo sapiens
IAYGTQGSSGYSLR

SEQ ID NO: 614 - protein, 7 aa, Homo sapiens
RDSLEFR

SEQ ID NO: 615 - protein, 11 aa, Homo sapiens
AGFSWIEVTFK

SEQ ID NO: 616 - protein, 25 aa, Homo sapiens
SLAPYAQDTQEKLNHQLEGLTFQMK

SEQ ID NO: 617 - protein, 10 aa, Homo sapiens
TPYADEFKVK

SEQ ID NO: 618 - protein, 11 aa, Homo sapiens
GNQDTSSQLKK

SEQ ID NO: 619 - protein, 12 aa, Homo sapiens
SLLDRFTEDAKR

SEQ ID NO: 620 - protein, 18 aa, Homo sapiens
SLEDKTERELLESYIDGR

SEQ ID NO: 621 - protein, 27 aa, Homo sapiens
MTMDKTGLLLLSDPDKVTIGLLFWDGR

SEQ ID NO: 622 - protein, 30 aa, Homo sapiens
EKAGFSWIEVTFKNPLVWVHASPEHVVVTR

SEQ ID NO: 623 - protein, 9 aa, Homo sapiens
GEIQNILQK

SEQ ID NO: 624 - protein, 12 aa, Homo sapiens
LQSLFDSPDFSK

SEQ ID NO: 625 - protein, 14 aa, Homo sapiens
TFEGHFDGVPVISK

SEQ ID NO: 626 - protein, 9 aa, Homo sapiens
MRDVVLFEK

SEQ ID NO: 627 - protein, 21 aa, Homo sapiens
VLRENADSLQASLRPHADELK

SEQ ID NO: 628 - protein, 20 aa, Homo sapiens
ELNQAGQETLVTGWGYHSSR

SEQ ID NO: 629 - protein, 33 aa, Homo sapiens
LDTSRDGWHSWPIAHQWPQGPSAVDAAFSWEEK

SEQ ID NO: 630 - protein, 21 aa, Homo sapiens
AEATTLHVAPQGTAMAVSTFR

SEQ ID NO: 631 - protein, 21 aa, Homo sapiens
DAQYAPGYDKVKDISEVVTPR

SEQ ID NO: 632 - protein, 14 aa, Homo sapiens
GGSASTWLTAFALR

SEQ ID NO: 633 - protein, 29 aa, Homo sapiens
SVTLFGESAGAASVSLHLLSPGSHSLFTR

SEQ ID NO: 634 - protein, 16 aa, Homo sapiens
ALNHLPLEYNSALYSR

SEQ ID NO: 635 - protein, 10 aa, Homo sapiens
GHMLENHVER

SEQ ID NO: 636 - protein, 20 aa, Homo sapiens
VAVPPLTEEDVLFNVNSDTR

SEQ ID NO: 637 - protein, 9 aa, Homo sapiens
PYADEFKVK

SEQ ID NO: 638 - protein, 12 aa, Homo sapiens
TNQVNSGGVLLR

SEQ ID NO: 639 - protein, 7 aa, Homo sapiens
PVDAAFR

SEQ ID NO: 640 - protein, 28 aa, Homo sapiens
TFSEWLESVKENPAVIDFELAPIVDLVR

SEQ ID NO: 641 - protein, 24 aa, Homo sapiens
VDDGVASFVLNLPSGVTVLEFNVK

SEQ ID NO: 642 - protein, 10 aa, Homo sapiens
WSSTSPHRPR

SEQ ID NO: 643 - protein, 22 aa, Homo sapiens
TILDDLRAEDHFSVIDFNQNIR

SEQ ID NO: 644 - protein, 13 aa, Homo sapiens
SPDVINGSPISQK

SEQ ID NO: 645 - protein, 15 aa, Homo sapiens
TMSEVGGSVEDLIAK

SEQ ID NO: 646 - protein, 18 aa, Homo sapiens
HPNSPLDEENLTQENQDR

SEQ ID NO: 647 - protein, 30 aa, Homo sapiens
DPKEYANQFMWEYSTNYGQAPLSLLVSYTK

SEQ ID NO: 648 - protein, 17 aa, Homo sapiens
TSIYPFLDFMPSPQVVR

SEQ ID NO: 649 - protein, 9 aa, Homo sapiens
WADLSGITK

SEQ ID NO: 650 - protein, 28 aa, Homo sapiens
SILQMSLDHHIVTPLTSLVIENEAGDER

SEQ ID NO: 651 - protein, 15 aa, Homo sapiens
LGNFPWQAFTSIHGR

SEQ ID NO: 652 - protein, 14 aa, Homo sapiens
VANYFDWISYHVGR

SEQ ID NO: 653 - protein, 23 aa, Homo sapiens
SVLLAQELPQQLTSPGYPEPYGK

SEQ ID NO: 654 - protein, 9 aa, Homo sapiens
VKENFDKAR

SEQ ID NO: 655 - protein, 25 aa, Homo sapiens
ELTPEVLQEWLDELEEMMLVVHMPR

SEQ ID NO: 656 - protein, 9 aa, Homo sapiens
TPDGSLLVR

SEQ ID NO: 657 - protein, 17 aa, Homo sapiens
AKLGNFPWQAFTSIHGR

SEQ ID NO: 658 - protein, 16 aa, Homo sapiens
LQDRGPDVLTATVSGK

SEQ ID NO: 659 - protein, 24 aa, Homo sapiens
HQMDLVATLSQLGLQELFQAPDLR

SEQ ID NO: 660 - protein, 15 aa, Homo sapiens
LDLQEINNWVQAQMK

SEQ ID NO: 661 - protein, 31 aa, Homo sapiens
RVINLPLDSMAAPWETGDTFPDVVAIAPDVR

SEQ ID NO: 662 - protein, 10 aa, Homo sapiens
LDRFTEDAKR

SEQ ID NO: 663 - protein, 38 aa, Homo sapiens
ETVLTFIDPEGSEVDMVEEIDHIGIISFPDFKIPSNPR

SEQ ID NO: 664 - protein, 19 aa, Homo sapiens
LYGSEAFATDFQDSAAAKK

SEQ ID NO: 665 - protein, 8 aa, Homo sapiens
ILDDLSPR

SEQ ID NO: 666 - protein, 7 aa, Homo sapiens
AFQYHSK

SEQ ID NO: 667 - protein, 11 aa, Homo sapiens
YTTTMGVNTYK

SEQ ID NO: 668 - protein, 7 aa, Homo sapiens
GTVYNYR

SEQ ID NO: 669 - protein, 11 aa, Homo sapiens
TWRNDLISATK

SEQ ID NO: 670 - protein, 14 aa, Homo sapiens
RAQLGDLPWQVAIK

SEQ ID NO: 671 - protein, 13 aa, Homo sapiens
ASLRPHADELKAK

SEQ ID NO: 672 - protein, 27 aa, Homo sapiens
SELTQQLNALFQDKLGEVNTYAGDLQK

SEQ ID NO: 673 - protein, 17 aa, Homo sapiens
WFLLEQPEIQVAHFPFK

SEQ ID NO: 674 - protein, 20 aa, Homo sapiens
STKEIPDEISILLLGVAHFK

SEQ ID NO: 675 - protein, 16 aa, Homo sapiens
SGAQATWTELPWPHEK

SEQ ID NO: 676 - protein, 9 aa, Homo sapiens
LSYEGEVTK

SEQ ID NO: 677 - protein, 12 aa, Homo sapiens
EVPLNTIIFMGR

SEQ ID NO: 678 - protein, 16 aa, Homo sapiens
VQEAHLTEDQIFYFPK

SEQ ID NO: 679 - protein, 15 aa, Homo sapiens
HLEVDVWVIEPQGLR

SEQ ID NO: 680 - protein, 13 aa, Homo sapiens
RPWNVASLIYETK

SEQ ID NO: 681 - protein, 11 aa, Homo sapiens
VQFELHYQEVK

SEQ ID NO: 682 - protein, 14 aa, Homo sapiens
DMPASEDLQDLQKK

SEQ ID NO: 683 - protein, 13 aa, Homo sapiens
AKIDQNVEELKGR

SEQ ID NO: 684 - protein, 13 aa, Homo sapiens
HGNTDSEGIVEVK

SEQ ID NO: 685 - protein, 8 aa, Homo sapiens
ISVIRPSK

SEQ ID NO: 686 - protein, 15 aa, Homo sapiens
KLWAYLTINQLLAER

SEQ ID NO: 687 - protein, 26 aa, Homo sapiens
RSLAPYAQDTQEKLNHQLEGLTFQMK

SEQ ID NO: 688 - protein, 12 aa, Homo sapiens
YGNQDTSSQLKK

SEQ ID NO: 689 - protein, 14 aa, Homo sapiens
LAAAVSNFGYDLYR

SEQ ID NO: 690 - protein, 7 aa, Homo sapiens
ERVYFFK

SEQ ID NO: 691 - protein, 11 aa, Homo sapiens
PGQVDAAMAGR

SEQ ID NO: 692 - protein, 10 aa, Homo sapiens
TIPELDQPPK

SEQ ID NO: 693 - protein, 12 aa, Homo sapiens
GTDYHKQPWQAK

SEQ ID NO: 694 - protein, 13 aa, Homo sapiens
KVTYTSQEDLVEK

SEQ ID NO: 695 - protein, 11 aa, Homo sapiens
QEMSKDLEEVK

SEQ ID NO: 696 - protein, 24 aa, Homo sapiens
AVPHPDSQPDTIDHDLLLLQLSEK

SEQ ID NO: 697 - protein, 23 aa, Homo sapiens
LPLLMDSVIQALAELEQKVPAAK

SEQ ID NO: 698 - protein, 19 aa, Homo sapiens
NVLVTLYERDEDNNLLTEK

SEQ ID NO: 699 - protein, 9 aa, Homo sapiens
DKYTFELSR

SEQ ID NO: 700 - protein, 15 aa, Homo sapiens
FSISGSYVLDQILPR

SEQ ID NO: 701 - protein, 12 aa, Homo sapiens
TSLEDFYLDEER

SEQ ID NO: 702 - protein, 22 aa, Homo sapiens
FSDASYQSINIPVTQNMVPSSR

SEQ ID NO: 703 - protein, 34 aa, Homo sapiens
FATTFYQHLADSKNDNDNIFLSPLSISTAFAMTK

SEQ ID NO: 704 - protein, 7 aa, Homo sapiens
FHNFMER

SEQ ID NO: 705 - protein, 14 aa, Homo sapiens
TWPHFTATVKPRPA

SEQ ID NO: 706 - protein, 16 aa, Homo sapiens
LVPPMEEDYPQFGSPK

SEQ ID NO: 707 - protein, 6 aa, Homo sapiens
SHKWDR

SEQ ID NO: 708 - protein, 12 aa, Homo sapiens
ITFELVYEELLK

SEQ ID NO: 709 - protein, 32 aa, Homo sapiens
HVIILMTDGLHNMGGDPITVIDEIRDLLYIGK

SEQ ID NO: 710 - protein, 13 aa, Homo sapiens
QLNEINYEDHKLK

SEQ ID NO: 711 - protein, 12 aa, Homo sapiens
GDSGGPLIVHKR

SEQ ID NO: 712 - protein, 13 aa, Homo sapiens
LGEVNTYAGDLQK

SEQ ID NO: 713 - protein, 16 aa, Homo sapiens
KMYFDAVQAIETHLIR

SEQ ID NO: 714 - protein, 16 aa, Homo sapiens
SPEQQETVLDGNLIIR

SEQ ID NO: 715 - protein, 19 aa, Homo sapiens
QLPGGQNPVSYVYLEVVSK

SEQ ID NO: 716 - protein, 11 aa, Homo sapiens
EKLQDEDLGFL

SEQ ID NO: 717 - protein, 10 aa, Homo sapiens
QGHNSVFLIK

SEQ ID NO: 718 - protein, 35 aa, Homo sapiens
GMVLDENYNNLANAVISVSGINHDVTSGDHGDYFR

SEQ ID NO: 719 - protein, 11 aa, Homo sapiens
LLDRFTEDAKR

SEQ ID NO: 720 - protein, 10 aa, Homo sapiens
VLNYVDWIKK

SEQ ID NO: 721 - protein, 19 aa, Homo sapiens
EPLDDYVNTQGASLFSVTK

SEQ ID NO: 722 - protein, 16 aa, Homo sapiens
SLDFTELDVAAEKIDR

SEQ ID NO: 723 - protein, 14 aa, Homo sapiens
KVTYTSQEDLVEKK

SEQ ID NO: 724 - protein, 15 aa, Homo sapiens
IQPSGGTNINEALLR

SEQ ID NO: 725 - protein, 9 aa, Homo sapiens
PFATELHER

SEQ ID NO: 726 - protein, 12 aa, Homo sapiens
RRVEPYGENFNK

SEQ ID NO: 727 - protein, 14 aa, Homo sapiens
FDPVRGEVPPRYPR

SEQ ID NO: 728 - protein, 17 aa, Homo sapiens
SLAELGGHLDQQVEEFR

SEQ ID NO: 729 - protein, 22 aa, Homo sapiens
SKLPGIVAEGRDDLYVSDAFHK

SEQ ID NO: 730 - protein, 11 aa, Homo sapiens
LKLSYEGEVTK

SEQ ID NO: 731 - protein, 11 aa, Homo sapiens
VRGEVPPRYPR

SEQ ID NO: 732 - protein, 20 aa, Homo sapiens
LDDLRAEDHFSVIDFNQNIR

SEQ ID NO: 733 - protein, 9 aa, Homo sapiens
VASYGVKPR

SEQ ID NO: 734 - protein, 10 aa, Homo sapiens
MDKYTFELSR

SEQ ID NO: 735 - protein, 15 aa, Homo sapiens
DVWGIEGPIDAAFTR

SEQ ID NO: 736 - protein, 8 aa, Homo sapiens
ELPEHTVK

SEQ ID NO: 737 - protein, 9 aa, Homo sapiens
STGSWSTLK

SEQ ID NO: 738 - protein, 13 aa, Homo sapiens
KTSLEDFYLDEER

SEQ ID NO: 739 - protein, 31 aa, Homo sapiens
TSNPYRVPANLENVGFEVQTAEDDLKTDFYK

SEQ ID NO: 740 - protein, 8 aa, Homo sapiens
FVSEEEKK

SEQ ID NO: 741 - protein, 12 aa, Homo sapiens
GDKVWVYPPEKK

SEQ ID NO: 742 - protein, 11 aa, Homo sapiens
LSNENHGIAQR

SEQ ID NO: 743 - protein, 11 aa, Homo sapiens
RVEPYGENFNK

SEQ ID NO: 744 - protein, 12 aa, Homo sapiens
GNLRGNTEGLQK

SEQ ID NO: 745 - protein, 7 aa, Homo sapiens
LWWLDLK

SEQ ID NO: 746 - protein, 10 aa, Homo sapiens
VFSLQWGEVK

SEQ ID NO: 747 - protein, 16 aa, Homo sapiens
ANTVQEATFQMELPKK

SEQ ID NO: 748 - protein, 16 aa, Homo sapiens
DWHGVPGQVDAAMAGR

SEQ ID NO: 749 - protein, 23 aa, Homo sapiens
VLRENADSLQASLRPHADELKAK

SEQ ID NO: 750 - protein, 11 aa, Homo sapiens
FYNQVSTPLLR

SEQ ID NO: 751 - protein, 10 aa, Homo sapiens
YWGVASFLQK

SEQ ID NO: 752 - protein, 17 aa, Homo sapiens
YQIWTTVVDWIHPDLKR

SEQ ID NO: 753 - protein, 12 aa, Homo sapiens
MKYWGVASFLQK

SEQ ID NO: 754 - protein, 10 aa, Homo sapiens
IDQTVEELRR

SEQ ID NO: 755 - protein, 11 aa, Homo sapiens
QLNEINYEDHK

SEQ ID NO: 756 - protein, 11 aa, Homo sapiens
RTHLPEVFLSK

SEQ ID NO: 757 - protein, 12 aa, Homo sapiens
SHKWDRELISER

SEQ ID NO: 758 - protein, 11 aa, Homo sapiens
IDQNVEELKGR

SEQ ID NO: 759 - protein, 11 aa, Homo sapiens
YGLVTYATYPK

SEQ ID NO: 760 - protein, 11 aa, Homo sapiens
ISASAEELRQR

SEQ ID NO: 761 - protein, 20 aa, Homo sapiens
EFSHLGKEDFTSLSLVLYSR

SEQ ID NO: 762 - protein, 13 aa, Homo sapiens
IYGNQDTSSQLKK

SEQ ID NO: 763 - protein, 15 aa, Homo sapiens
KFPSGTFEQVSQLVK

SEQ ID NO: 764 - protein, 10 aa, Homo sapiens
NLAVSQVVHK

SEQ ID NO: 765 - protein, 11 aa, Homo sapiens
VMDKYTFELSR

SEQ ID NO: 766 - protein, 13 aa, Homo sapiens
WKNFPSPVDAAFR

SEQ ID NO: 767 - protein, 8 aa, Homo sapiens
RLWWLDLK

SEQ ID NO: 768 - protein, 10 aa, Homo sapiens
QGIPFFGQVR

SEQ ID NO: 769 - protein, 14 aa, Homo sapiens
LVHVEEPHTETVRK

SEQ ID NO: 770 - protein, 13 aa, Homo sapiens
LVHVEEPHTETVR

SEQ ID NO: 771 - protein, 13 aa, Homo sapiens
VTFELTYEELLKR

SEQ ID NO: 772 - protein, 16 aa, Homo sapiens
GILGPQLHADVGDKVK

SEQ ID NO: 773 - protein, 14 aa, Homo sapiens
ALHQVFEHMLDVSK

SEQ ID NO: 774 - protein, 14 aa, Homo sapiens
KGHVSFKPSLDQQR

SEQ ID NO: 775 - protein, 11 aa, Homo sapiens
AIGYLNTGYQR

SEQ ID NO: 776 - protein, 8 aa, Homo sapiens
FMETVAEK

SEQ ID NO: 777 - protein, 8 aa, Homo sapiens
YGAATFTR

SEQ ID NO: 778 - protein, 13 aa, Homo sapiens
VYSLNDDLKPAKR

SEQ ID NO: 779 - protein, 18 aa, Homo sapiens
RPVLFQEYLDIDQMIFNR

SEQ ID NO: 780 - protein, 11 aa, Homo sapiens
VGFYESDVMGR

SEQ ID NO: 781 - protein, 10 aa, Homo sapiens
SIYKPGQTVK

SEQ ID NO: 782 - protein, 17 aa, Homo sapiens
YVRPGGGFVPNFQLFEK

SEQ ID NO: 783 - protein, 10 aa, Homo sapiens
PLSIEPIGVR

SEQ ID NO: 784 - protein, 12 aa, Homo sapiens
VSDPKFHPLHSK

SEQ ID NO: 785 - protein, 15 aa, Homo sapiens
YLYHGQTLETLGGKK

SEQ ID NO: 786 - protein, 17 aa, Homo sapiens
PEARPNSMVVEHPEFLK

SEQ ID NO: 787 - protein, 14 aa, Homo sapiens
TEHPFTVEEFVLPK

SEQ ID NO: 788 - protein, 8 aa, Homo sapiens
ITQDAQLK

SEQ ID NO: 789 - protein, 11 aa, Homo sapiens
SPYQLVLQHSR

SEQ ID NO: 790 - protein, 12 aa, Homo sapiens
WVFKEEDPIHLR

SEQ ID NO: 791 - protein, 20 aa, Homo sapiens
IEEVFKEVQNLKEIVNSLKK

SEQ ID NO: 792 - protein, 9 aa, Homo sapiens
YGTLFTMDR

SEQ ID NO: 793 - protein, 28 aa, Homo sapiens
GLFQVVSGGMVLQLQQGDQVWVEKDPKK

SEQ ID NO: 794 - protein, 22 aa, Homo sapiens
YHFVTPLTSMVVTKPEDNEDER

SEQ ID NO: 795 - protein, 14 aa, Homo sapiens
GQLGSPLGNPPGKK

SEQ ID NO: 796 - protein, 19 aa, Homo sapiens
MSAQTHGLLGQFFQPFDFK

SEQ ID NO: 797 - protein, 8 aa, Homo sapiens
QIYKDLLR

SEQ ID NO: 798 - protein, 8 aa, Homo sapiens
FTVETPDK

SEQ ID NO: 799 - protein, 16 aa, Homo sapiens
EGGPSQIGDALGFAVR

SEQ ID NO: 800 - protein, 12 aa, Homo sapiens
DEDMNSFKADVK

SEQ ID NO: 801 - protein, 9 aa, Homo sapiens
TFAHYATFR

SEQ ID NO: 802 - protein, 15 aa, Homo sapiens
LAYAFALAGNQDKRK

SEQ ID NO: 803 - protein, 17 aa, Homo sapiens
LDDYVNTQGASLFSVTK

SEQ ID NO: 804 - protein, 9 aa, Homo sapiens
GKFSVVYAK

SEQ ID NO: 805 - protein, 16 aa, Homo sapiens
YPIEHGIITNWDDMEK

SEQ ID NO: 806 - protein, 20 aa, Homo sapiens
VHVSEEGTEPEAMLQVLGPK

SEQ ID NO: 807 - protein, 29 aa, Homo sapiens
FPLYNLGFGNNLNYNFLENMALENHGFAR

SEQ ID NO: 808 - protein, 20 aa, Homo sapiens
EVELIVQEKPFTVEISPGPR

SEQ ID NO: 809 - protein, 14 aa, Homo sapiens
QEPGENSEILPTLK

SEQ ID NO: 810 - protein, 14 aa, Homo sapiens
WTYHYSEKPMNWQR

SEQ ID NO: 811 - protein, 13 aa, Homo sapiens
ILAGPAGDSNVVK

SEQ ID NO: 812 - protein, 16 aa, Homo sapiens
TIITTPPLKDFSLWEK

SEQ ID NO: 813 - protein, 15 aa, Homo sapiens
ALQERDYIFGNYIER

SEQ ID NO: 814 - protein, 10 aa, Homo sapiens
TDRFLVNLVK

SEQ ID NO: 815 - protein, 10 aa, Homo sapiens
DYIFGNYIER

SEQ ID NO: 816 - protein, 25 aa, Homo sapiens
IFNFEKAYFILDEFIIGGEIQETSK

SEQ ID NO: 817 - protein, 8 aa, Homo sapiens
SYYWIGIR

SEQ ID NO: 818 - protein, 14 aa, Homo sapiens
IVFPHGITLDLVSR

SEQ ID NO: 819 - protein, 9 aa, Homo sapiens
SIPQVSPVR

SEQ ID NO: 820 - protein, 14 aa, Homo sapiens
QKISEGLPALEFPN

SEQ ID NO: 821 - protein, 12 aa, Homo sapiens
YGMVAQVTQTLK

SEQ ID NO: 822 - protein, 28 aa, Homo sapiens
QAAGSGHLLALGTPENPSWLSLHLQDQK

SEQ ID NO: 823 - protein, 14 aa, Homo sapiens
TGTHGLLVKQEDMK

SEQ ID NO: 824 - protein, 10 aa, Homo sapiens
LTSLPLGALR

SEQ ID NO: 825 - protein, 7 aa, Homo sapiens
QINSYVK

SEQ ID NO: 826 - protein, 10 aa, Homo sapiens
STTAVVTNPK

SEQ ID NO: 827 - protein, 17 aa, Homo sapiens
SSFTVQDLKPFTEYVFR

SEQ ID NO: 828 - protein, 15 aa, Homo sapiens
PHAGDVEGHLSFLEK

SEQ ID NO: 829 - protein, 17 aa, Homo sapiens
NMAEQIIQEIYSQIQSK

SEQ ID NO: 830 - protein, 18 aa, Homo sapiens
RAPYPNYDRDILTIDIGR

SEQ ID NO: 831 - protein, 23 aa, Homo sapiens
YAGSQVASTSEVLKYTLFQIFSK

SEQ ID NO: 832 - protein, 15 aa, Homo sapiens
SSSNEEVMFLTVQVK

SEQ ID NO: 833 - protein, 7 aa, Homo sapiens
RKEYEMK

SEQ ID NO: 834 - protein, 8 aa, Homo sapiens
WPEPVFGR

SEQ ID NO: 835 - protein, 19 aa, Homo sapiens
AVNRADTAKEVSFDVELPK

SEQ ID NO: 836 - protein, 23 aa, Homo sapiens
SVSGKPQYMVLVPSLLHTETTEK

SEQ ID NO: 837 - protein, 17 aa, Homo sapiens
WNFEKFLVGPDGIPIMR

SEQ ID NO: 838 - protein, 11 aa, Homo sapiens
FWEPMKVHDIR

SEQ ID NO: 839 - protein, 17 aa, Homo sapiens
VGSPNAAVLWLWSSHNR

SEQ ID NO: 840 - protein, 36 aa, Homo sapiens
VNQNLVYESGSLNFSKLEIQSQVDSQHVGHSVLTAK

SEQ ID NO: 841 - protein, 15 aa, Homo sapiens
VRDIEHLTSLDFFRK

SEQ ID NO: 842 - protein, 18 aa, Homo sapiens
SGGRTEHPFTVEEFVLPK

SEQ ID NO: 843 - protein, 14 aa, Homo sapiens
TLYALSHAVNNYHK

SEQ ID NO: 844 - protein, 10 aa, Homo sapiens
SAVDAGFLQK

SEQ ID NO: 845 - protein, 17 aa, Homo sapiens
TEHGSEMLFFGNAIEGK

SEQ ID NO: 846 - protein, 15 aa, Homo sapiens
VLHPLEGAVVIIFKK

SEQ ID NO: 847 - protein, 20 aa, Homo sapiens
NEEAVKKDNSVHWERPQKPK

SEQ ID NO: 848 - protein, 21 aa, Homo sapiens
EFNLQNMGLPDFHIPENLFLK

SEQ ID NO: 849 - protein, 14 aa, Homo sapiens
DTVGTIQLINDHVK

SEQ ID NO: 850 - protein, 13 aa, Homo sapiens
NEQEQPLGQWHLS

SEQ ID NO: 851 - protein, 9 aa, Homo sapiens
SFYTAYLQR

SEQ ID NO: 852 - protein, 14 aa, Homo sapiens
LKSWFEPLVEDMQR

SEQ ID NO: 853 - protein, 12 aa, Homo sapiens
VQLTGEPVPMAR

SEQ ID NO: 854 - protein, 19 aa, Homo sapiens
VAVVEYHDGSHAYIGLKDR

SEQ ID NO: 855 - protein, 15 aa, Homo sapiens
ATISHVSPDSLYLFR

SEQ ID NO: 856 - protein, 15 aa, Homo sapiens
AATVGSLAGQPLQER

SEQ ID NO: 857 - protein, 8 aa, Homo sapiens
KLPDATPK

SEQ ID NO: 858 - protein, 14 aa, Homo sapiens
LWAYLTIEQLLEKR

SEQ ID NO: 859 - protein, 21 aa, Homo sapiens
IANDNSLNHEYLPILGLAEFR

SEQ ID NO: 860 - protein, 16 aa, Homo sapiens
AGLAASLAGPHSIVGR

SEQ ID NO: 861 - protein, 11 aa, Homo sapiens
KTLLSNLEEAK

SEQ ID NO: 862 - protein, 15 aa, Homo sapiens
LSVAVLREDFQIQPR

SEQ ID NO: 863 - protein, 15 aa, Homo sapiens
IFYNQQNHYDGSTGK

SEQ ID NO: 864 - protein, 23 aa, Homo sapiens
QQNAQGGFSSTQDTVVALHALSK

SEQ ID NO: 865 - protein, 12 aa, Homo sapiens
DLLPASLGSYYR

SEQ ID NO: 866 - protein, 11 aa, Homo sapiens
AVFPSIVGRPR

SEQ ID NO: 867 - protein, 11 aa, Homo sapiens
ALFLETEQLKK

SEQ ID NO: 868 - protein, 46 aa, Homo sapiens
APVGHFYEPQAPSAEVEMTSYVLLAYLTAQPAPTSEDLTSATNIVK

SEQ ID NO: 869 - protein, 10 aa, Homo sapiens
QTVSWAVTPK

SEQ ID NO: 870 - protein, 18 aa, Homo sapiens
VTVFPIGIGDRYDAAQLR

SEQ ID NO: 871 - protein, 8 aa, Homo sapiens
SDIAPVAR

SEQ ID NO: 872 - protein, 15 aa, Homo sapiens
TITKLSFVKVDSHFR

SEQ ID NO: 873 - protein, 7 aa, Homo sapiens
LFWEPMK

SEQ ID NO: 874 - protein, 12 aa, Homo sapiens
FVELTMPYSVIR

SEQ ID NO: 875 - protein, 16 aa, Homo sapiens
WKYEKPDGSPVFIAFR

SEQ ID NO: 876 - protein, 10 aa, Homo sapiens
VLEKDSVTLK

SEQ ID NO: 877 - protein, 11 aa, Homo sapiens
SSGSLLNNAIK

SEQ ID NO: 878 - protein, 11 aa, Homo sapiens
SPPKQAEAVLK

SEQ ID NO: 879 - protein, 12 aa, Homo sapiens
LFWEPMKVHDIR

SEQ ID NO: 880 - protein, 11 aa, Homo sapiens
HVEEPHTETVR

SEQ ID NO: 881 - protein, 16 aa, Homo sapiens
GEAFTLKATVLNYLPK

SEQ ID NO: 882 - protein, 13 aa, Homo sapiens
FDWQYINPVAHMK

SEQ ID NO: 883 - protein, 20 aa, Homo sapiens
AHFSPSNIILDFPAAGSAAR

SEQ ID NO: 884 - protein, 12 aa, Homo sapiens
LDDGRWHQVEVK

SEQ ID NO: 885 - protein, 15 aa, Homo sapiens
LGGPEAGLGEYLFER

SEQ ID NO: 886 - protein, 24 aa, Homo sapiens
LELELRPTGEIEQYSVSATYELQR

SEQ ID NO: 887 - protein, 13 aa, Homo sapiens
LAGAPSEDPQFPK

SEQ ID NO: 888 - protein, 11 aa, Homo sapiens
LSKELQAAQAR

SEQ ID NO: 889 - protein, 6 aa, Homo sapiens
ANLFNK

SEQ ID NO: 890 - protein, 31 aa, Homo sapiens
FIEDNIEYITIIAFAQYVQEATFEEMEKLVK

SEQ ID NO: 891 - protein, 11 aa, Homo sapiens
GFIEGHVVIPR

SEQ ID NO: 892 - protein, 26 aa, Homo sapiens
FRVVSMDENFHPLNELIPLVYIQDPK

SEQ ID NO: 893 - protein, 10 aa, Homo sapiens
PPKQAEAVLK

SEQ ID NO: 894 - protein, 12 aa, Homo sapiens
RHPDLSIPELLR

SEQ ID NO: 895 - protein, 8 aa, Homo sapiens
PSIVGRPR

SEQ ID NO: 896 - protein, 34 aa, Homo sapiens
KYFPETWIWDLVVVNSAGVAEVGVTVPDTITEWK

SEQ ID NO: 897 - protein, 24 aa, Homo sapiens
AFQPFFVELTMPYSVIRGEAFTLK

SEQ ID NO: 898 - protein, 18 aa, Homo sapiens
LLLQQVSLPELPGEYSMK

SEQ ID NO: 899 - protein, 11 aa, Homo sapiens
ILHLPTSWDWR

SEQ ID NO: 900 - protein, 16 aa, Homo sapiens
YGRNQGNTWLTAFVLK

SEQ ID NO: 901 - protein, 27 aa, Homo sapiens
GAVDHKLSLESLTSYFSIESSTKGDVK

SEQ ID NO: 902 - protein, 11 aa, Homo sapiens
PVKSDIAPVAR

SEQ ID NO: 903 - protein, 17 aa, Homo sapiens
YTIITTPPLKDFSLWEK

SEQ ID NO: 904 - protein, 13 aa, Homo sapiens
NQGNTWLTAFVLK

SEQ ID NO: 905 - protein, 14 aa, Homo sapiens
SFPLSSEPFQGSYK

SEQ ID NO: 906 - protein, 9 aa, Homo sapiens
TGTHGLLVK

SEQ ID NO: 907 - protein, 35 aa, Homo sapiens
IAQWQSFQLEGGLKQFSFPLSSEPFQGSYKVVVQK

SEQ ID NO: 908 - protein, 10 aa, Homo sapiens
WVMVPMMSLH

SEQ ID NO: 909 - protein, 8 aa, Homo sapiens
PTLLTLPR

SEQ ID NO: 910 - protein, 15 aa, Homo sapiens
SLEVTFTPVIEDIGK

SEQ ID NO: 911 - protein, 21 aa, Homo sapiens
ALLAYAFALAGNQDKRKEVLK

SEQ ID NO: 912 - protein, 9 aa, Homo sapiens
KSQLVYQSR

SEQ ID NO: 913 - protein, 14 aa, Homo sapiens
KDNSVHWERPQKPK

SEQ ID NO: 914 - protein, 18 aa, Homo sapiens
EPAHLMSLFGGKPMIIYK

SEQ ID NO: 915 - protein, 16 aa, Homo sapiens
ELSHLPSLYDYSAYRR

SEQ ID NO: 916 - protein, 12 aa, Homo sapiens
SWFEPLVEDMQR

SEQ ID NO: 917 - protein, 8 aa, Homo sapiens
FLEPMEEK

SEQ ID NO: 918 - protein, 8 aa, Homo sapiens
LHVAGNLK

SEQ ID NO: 919 - protein, 8 aa, Homo sapiens
DLKPAIVK

SEQ ID NO: 920 - protein, 12 aa, Homo sapiens
LDNIYSSDKFYK

SEQ ID NO: 921 - protein, 11 aa, Homo sapiens
SASNMAIVDVK

SEQ ID NO: 922 - protein, 7 aa, Homo sapiens
FLVNLVK

SEQ ID NO: 923 - protein, 12 aa, Homo sapiens
PLVYIQDPKGNR

SEQ ID NO: 924 - protein, 10 aa, Homo sapiens
SFVKVDSHFR

SEQ ID NO: 925 - protein, 15 aa, Homo sapiens
KVEQAVETEPEPELR

SEQ ID NO: 926 - protein, 13 aa, Homo sapiens
AQEGDHGSHVYTK

SEQ ID NO: 927 - protein, 19 aa, Homo sapiens
DSWLDKQAEISASAPTSLR

SEQ ID NO: 928 - protein, 25 aa, Homo sapiens
TWDPEGVIFYGDTNPKDDWFMLGLR

SEQ ID NO: 929 - protein, 14 aa, Homo sapiens
LALWGEHTGQLYSK

SEQ ID NO: 930 - protein, 8 aa, Homo sapiens
SLWEHSTK

SEQ ID NO: 931 - protein, 7 aa, Homo sapiens
PHTETVR

SEQ ID NO: 932 - protein, 9 aa, Homo sapiens
GPTQEFKKR

SEQ ID NO: 933 - protein, 13 aa, Homo sapiens
TKNSEEFAAAMSR

SEQ ID NO: 934 - protein, 23 aa, Homo sapiens
WVQTLSEQVQEELLSSQVTQELR

SEQ ID NO: 935 - protein, 14 aa, Homo sapiens
IALGGLLFPASNLR

SEQ ID NO: 936 - protein, 6 aa, Homo sapiens
TTVMVK

SEQ ID NO: 937 - protein, 8 aa, Homo sapiens
AGNQDKRK

SEQ ID NO: 938 - protein, 9 aa, Homo sapiens
ENSQYQPIK

SEQ ID NO: 939 - protein, 9 aa, Homo sapiens
FAHNVVTMR

SEQ ID NO: 940 - protein, 23 aa, Homo sapiens
WKNFPSPVDAAFRQGHNSVFLIK

SEQ ID NO: 941 - protein, 19 aa, Homo sapiens
IYTSPTWSAFVTDSSWSAR

SEQ ID NO: 942 - protein, 23 aa, Homo sapiens
ADSVVDLLSYNVQGSGETTYDHK

SEQ ID NO: 943 - protein, 25 aa, Homo sapiens
SLALGTFAHTPALASLGLSNNRLSR

SEQ ID NO: 944 - protein, 11 aa, Homo sapiens
LSFVKVDSHFR

SEQ ID NO: 945 - protein, 37 aa, Homo sapiens
VMAVDALASSHPLSTPASEINTPAQISELFDAISYSK

SEQ ID NO: 946 - protein, 18 aa, Homo sapiens
GHFSISIPVKSDIAPVAR

SEQ ID NO: 947 - protein, 23 aa, Homo sapiens
TEHPFTVEEFVLPKFEVQVTVPK

SEQ ID NO: 948 - protein, 20 aa, Homo sapiens
FFTREPQDTYHYLPFSLPHR

SEQ ID NO: 949 - protein, 12 aa, Homo sapiens
GVPIPNKVIFIR

SEQ ID NO: 950 - protein, 13 aa, Homo sapiens
LWAYLTIEQLLEK

SEQ ID NO: 951 - protein, 20 aa, Homo sapiens
NKYGMVAQVTQTLKLEDTPK

SEQ ID NO: 952 - protein, 11 aa, Homo sapiens
KLSFYYLIMAK

SEQ ID NO: 953 - protein, 22 aa, Homo sapiens
ALALPPLGLAPLLNLWAKPQGR

SEQ ID NO: 954 - protein, 27 aa, Homo sapiens
WITKQQNAQGGFSSTQDTVVALHALSK

SEQ ID NO: 955 - protein, 7 aa, Homo sapiens
PFFGQVR

SEQ ID NO: 956 - protein, 11 aa, Homo sapiens
LLRDADDLQKR

SEQ ID NO: 957 - protein, 7 aa, Homo sapiens
GISMLNK

SEQ ID NO: 958 - protein, 9 aa, Homo sapiens
LQAEAFQAR

SEQ ID NO: 959 - protein, 13 aa, Homo sapiens
IALLLMASQEPQR

SEQ ID NO: 960 - protein, 6 aa, Homo sapiens
FYTFLK

SEQ ID NO: 961 - protein, 17 aa, Homo sapiens
AASGTQNNVLRGEPFIR

SEQ ID NO: 962 - protein, 27 aa, Homo sapiens
SGGRTEHPFTVEEFVLPKFEVQVTVPK

SEQ ID NO: 963 - protein, 19 aa, Homo sapiens
NQGNTWLTAFVLKTFAQAR

SEQ ID NO: 964 - protein, 31 aa, Homo sapiens
HNVYINGITYTPVSSTNEKDMYSFLEDMGLK

SEQ ID NO: 965 - protein, 21 aa, Homo sapiens
YYPYQSFQTPQHPSFLFQDKR

SEQ ID NO: 966 - protein, 12 aa, Homo sapiens
YFHHNSDFYIPK

SEQ ID NO: 967 - protein, 7 aa, Homo sapiens
TKVFQLK

SEQ ID NO: 968 - protein, 17 aa, Homo sapiens
TLQALEFHTVPFQLLAR

SEQ ID NO: 969 - protein, 21 aa, Homo sapiens
SGKPQYMVLVPSLLHTETTEK

SEQ ID NO: 970 - protein, 8 aa, Homo sapiens
AFTDLHLR

SEQ ID NO: 971 - protein, 9 aa, Homo sapiens
NMATRPYSI

SEQ ID NO: 972 - protein, 11 aa, Homo sapiens
AASGTQNNVLR

SEQ ID NO: 973 - protein, 23 aa, Homo sapiens
QEDMKGHFSISIPVKSDIAPVAR

SEQ ID NO: 974 - protein, 28 aa, Homo sapiens
FSSHVGGTLGQFYQEVLWGSPAASDDGR

SEQ ID NO: 975 - protein, 16 aa, Homo sapiens
DTVIKPLLVEPEGLEK

SEQ ID NO: 976 - protein, 10 aa, Homo sapiens
RIDITLSSVK

SEQ ID NO: 977 - protein, 21 aa, Homo sapiens
RLIDQYGTHYLQSGSLGGEYR

SEQ ID NO: 978 - protein, 12 aa, Homo sapiens
DEIPHNDIALLK

SEQ ID NO: 979 - protein, 6 aa, Homo sapiens
TFAQAR

SEQ ID NO: 980 - protein, 18 aa, Homo sapiens
AYKSELEEQLTPVAEETR

SEQ ID NO: 981 - protein, 8 aa, Homo sapiens
PYGENFNK

SEQ ID NO: 982 - protein, 21 aa, Homo sapiens
TPDVSSALDKLKEFGNTLEDK

SEQ ID NO: 983 - protein, 18 aa, Homo sapiens
LLIYAVLPTGDVIGDSAK

SEQ ID NO: 984 - protein, 11 aa, Homo sapiens
SNTVASLHTEK

SEQ ID NO: 985 - protein, 6 aa, Homo sapiens
RHPIMR

SEQ ID NO: 986 - protein, 22 aa, Homo sapiens
NEDSLVFVQTDKSIYKPGQTVK

SEQ ID NO: 987 - protein, 20 aa, Homo sapiens
LTAQPAPTSEDLTSATNIVK

SEQ ID NO: 988 - protein, 21 aa, Homo sapiens
EHGDPLIEELNPGDALEPEGR

SEQ ID NO: 989 - protein, 10 aa, Homo sapiens
TPEGLTLLFK

SEQ ID NO: 990 - protein, 19 aa, Homo sapiens
ASGSLPYTQTLQDHLNSLK

SEQ ID NO: 991 - protein, 8 aa, Homo sapiens
PNKVIFIR

SEQ ID NO: 992 - protein, 11 aa, Homo sapiens
ALMDETMKELK

SEQ ID NO: 993 - protein, 10 aa, Homo sapiens
PELPGEYSMK

SEQ ID NO: 994 - protein, 9 aa, Homo sapiens
FYVDSEKLK

SEQ ID NO: 995 - protein, 12 aa, Homo sapiens
DMYSFLEDMGLK

SEQ ID NO: 996 - protein, 20 aa, Homo sapiens
LEIQSQVDSQHVGHSVLTAK

SEQ ID NO: 997 - protein, 7 aa, Homo sapiens
VLNYLPK

SEQ ID NO: 998 - protein, 11 aa, Homo sapiens
LKQHIEAIDVR

SEQ ID NO: 999 - protein, 10 aa, Homo sapiens
AVDTWSWGER

SEQ ID NO: 1000 - protein, 14 aa, Homo sapiens
TEVSSNHVLIYLDK

SEQ ID NO: 1001 - protein, 19 aa, Homo sapiens
DIPQPHAEPWAFSLDLGLK

SEQ ID NO: 1002 - protein, 11 aa, Homo sapiens
FDGILGMAYPR

SEQ ID NO: 1003 - protein, 10 aa, Homo sapiens
EVALDLSQHK

SEQ ID NO: 1004 - protein, 9 aa, Homo sapiens
MDETMKELK

SEQ ID NO: 1005 - protein, 12 aa, Homo sapiens
PHDFENGEYWPR

SEQ ID NO: 1006 - protein, 16 aa, Homo sapiens
TRDRLDEVKEQVAEVR

SEQ ID NO: 1007 - protein, 27 aa, Homo sapiens
AVDQSVLLMKPDAELSASSVYNLLPEK

SEQ ID NO: 1008 - protein, 12 aa, Homo sapiens
LPTGDVIGDSAK

SEQ ID NO: 1009 - protein, 9 aa, Homo sapiens
SVFVDWIHK

SEQ ID NO: 1010 - protein, 15 aa, Homo sapiens
IGQDGISTSATTNLK

SEQ ID NO: 1011 - protein, 13 aa, Homo sapiens
DNSALDPIIHGLK

SEQ ID NO: 1012 - protein, 15 aa, Homo sapiens
ALLAYAFALAGNQDK

SEQ ID NO: 1013 - protein, 9 aa, Homo sapiens
IEDGTLASK

SEQ ID NO: 1014 - protein, 6 aa, Homo sapiens
NIFNFK

SEQ ID NO: 1015 - protein, 7 aa, Homo sapiens
GEAFTLK

SEQ ID NO: 1016 - protein, 17 aa, Homo sapiens
KDTVIKPLLVEPEGLEK

SEQ ID NO: 1017 - protein, 12 aa, Homo sapiens
NKDDEEFIESNK

SEQ ID NO: 1018 - protein, 15 aa, Homo sapiens
EVGPPLPQEAVPLQK

SEQ ID NO: 1019 - protein, 15 aa, Homo sapiens
DGKGVPIPNKVIFIR

SEQ ID NO: 1020 - protein, 12 aa, Homo sapiens
LVDGKGVPIPNK

SEQ ID NO: 1021 - protein, 31 aa, Homo sapiens
GLELEPGAGLFVAQAGGADPDKFQGVIAELK

SEQ ID NO: 1022 - protein, 13 aa, Homo sapiens
YSSDYFQAPSDYR

SEQ ID NO: 1023 - protein, 11 aa, Homo sapiens
SYTSHTNEIHK

SEQ ID NO: 1024 - protein, 15 aa, Homo sapiens
VIVIPVGIGPHANLK

SEQ ID NO: 1025 - protein, 7 aa, Homo sapiens
VYFFKGK

SEQ ID NO: 1026 - protein, 7 aa, Homo sapiens
GPTQEFK

SEQ ID NO: 1027 - protein, 29 aa, Homo sapiens
FRVVSMDENFHPLNELIPLVYIQDPKGNR

SEQ ID NO: 1028 - protein, 14 aa, Homo sapiens
IAQWQSFQLEGGLK

SEQ ID NO: 1029 - protein, 14 aa, Homo sapiens
SIIDELFQDRFFTR

SEQ ID NO: 1030 - protein, 11 aa, Homo sapiens
PVGIGPHANLK

SEQ ID NO: 1031 - protein, 26 aa, Homo sapiens
FQVDNNNRLLLQQVSLPELPGEYSMK

SEQ ID NO: 1032 - protein, 8 aa, Homo sapiens
TGHVIAVK

SEQ ID NO: 1033 - protein, 20 aa, Homo sapiens
AYIFIDEAHITQALIWLSQR

SEQ ID NO: 1034 - protein, 30 aa, Homo sapiens
IAQWQSFQLEGGLKQFSFPLSSEPFQGSYK

SEQ ID NO: 1035 - protein, 9 aa, Homo sapiens
LAVYQAGAR

SEQ ID NO: 1036 - protein, 18 aa, Homo sapiens
TTVMVKNEDSLVFVQTDK

SEQ ID NO: 1037 - protein, 17 aa, Homo sapiens
AFQPFFVELTMPYSVIR

SEQ ID NO: 1038 - protein, 20 aa, Homo sapiens
VVEEPNAFGVNNPFLPQASR

SEQ ID NO: 1039 - protein, 33 aa, Homo sapiens
TEVSSNHVLIYLDKVSNQTLSLFFTVLQDVPVR

SEQ ID NO: 1040 - protein, 12 aa, Homo sapiens
NEDSLVFVQTDK

SEQ ID NO: 1041 - protein, 8 aa, Homo sapiens
MQAVTGWK

SEQ ID NO: 1042 - protein, 30 aa, Homo sapiens
LNTDIAGLASAIDMSTNYNSDSLHFSNVFR

SEQ ID NO: 1043 - protein, 12 aa, Homo sapiens
ASHEEVEGLVEK

SEQ ID NO: 1044 - protein, 10 aa, Homo sapiens
VKEEVFIQQR

SEQ ID NO: 1045 - protein, 28 aa, Homo sapiens
TTVMVKNEDSLVFVQTDKSIYKPGQTVK

SEQ ID NO: 1046 - protein, 18 aa, Homo sapiens
IHSGSFQSQVELSNDQEK

SEQ ID NO: 1047 - protein, 22 aa, Homo sapiens
ALEKYKEENDDFASFRVDRIER

SEQ ID NO: 1048 - protein, 10 aa, Homo sapiens
QNDFNSVEEK

SEQ ID NO: 1049 - protein, 13 aa, Homo sapiens
MVSGFIPLKPTVK

SEQ ID NO: 1050 - protein, 11 aa, Homo sapiens
VLFYVDSEKLK

SEQ ID NO: 1051 - protein, 14 aa, Homo sapiens
ELSEALGQIFDSQR

SEQ ID NO: 1052 - protein, 8 aa, Homo sapiens
VKVDSHFR

SEQ ID NO: 1053 - protein, 10 aa, Homo sapiens
LSFYYLIMAK

SEQ ID NO: 1054 - protein, 9 aa, Homo sapiens
QVVAGLNFR

SEQ ID NO: 1055 - protein, 14 aa, Homo sapiens
LAYAFALAGNQDKR

SEQ ID NO: 1056 - protein, 11 aa, Homo sapiens
AVVFLEPQWYR

SEQ ID NO: 1057 - protein, 17 aa, Homo sapiens
VQAAVGTSAAPVPSDNH

SEQ ID NO: 1058 - protein, 8 aa, Homo sapiens
ELNELGSK

SEQ ID NO: 1059 - protein, 36 aa, Homo sapiens
IAQWQSFQLEGGLKQFSFPLSSEPFQGSYKVVVQKK

SEQ ID NO: 1060 - protein, 8 aa, Homo sapiens
SGWHFVVK

SEQ ID NO: 1061 - protein, 12 aa, Homo sapiens
KVFSGDGKDFYR

SEQ ID NO: 1062 - protein, 12 aa, Homo sapiens
VPSLLHTETTEK

SEQ ID NO: 1063 - protein, 10 aa, Homo sapiens
VYELNPLDHR

SEQ ID NO: 1064 - protein, 14 aa, Homo sapiens
PAPLVAPGNQVTLR

SEQ ID NO: 1065 - protein, 7 aa, Homo sapiens
PGEYSMK

SEQ ID NO: 1066 - protein, 19 aa, Homo sapiens
HNVYINGITYTPVSSTNEK

SEQ ID NO: 1067 - protein, 16 aa, Homo sapiens
ALLAYAFALAGNQDKR

SEQ ID NO: 1068 - protein, 21 aa, Homo sapiens
ASQSVSSYLAWYQQKPGQAPR

SEQ ID NO: 1069 - protein, 10 aa, Homo sapiens
PIPNKVIFIR

SEQ ID NO: 1070 - protein, 14 aa, Homo sapiens
HFEIEVDIFEPQGI

SEQ ID NO: 1071 - protein, 22 aa, Homo sapiens
SGVQMNTNFFHESGLEAHVALK

SEQ ID NO: 1072 - protein, 22 aa, Homo sapiens
QFSFPLSSEPFQGSYKVVVQKK

SEQ ID NO: 1073 - protein, 19 aa, Homo sapiens
VDLSFSPSQSLPASHAHLR

SEQ ID NO: 1074 - protein, 16 aa, Homo sapiens
THPVEVFEPGAEHIVR

SEQ ID NO: 1075 - protein, 18 aa, Homo sapiens
TGKAAQVTIQSSGTFSSK

SEQ ID NO: 1076 - protein, 19 aa, Homo sapiens
KSGGRTEHPFTVEEFVLPK

SEQ ID NO: 1077 - protein, 24 aa, Homo sapiens
SSSNEEVMFLTVQVKGPTQEFKKR

SEQ ID NO: 1078 - protein, 25 aa, Homo sapiens
IDFLNNYALFLSPSAQQASWQVSAR

SEQ ID NO: 1079 - protein, 15 aa, Homo sapiens
DGFVQDEGTMFPVGK

SEQ ID NO: 1080 - protein, 16 aa, Homo sapiens
QFSFPLSSEPFQGSYK

SEQ ID NO: 1081 - protein, 28 aa, Homo sapiens
AGFSWIEVTFKNPLVWVHASPEHVVVTR

SEQ ID NO: 1082 - protein, 27 aa, Homo sapiens
VVSMDENFHPLNELIPLVYIQDPKGNR

SEQ ID NO: 1083 - protein, 10 aa, Homo sapiens
LDFSSQADLR

SEQ ID NO: 1084 - protein, 11 aa, Homo sapiens
LPPNVVEESAR

SEQ ID NO: 1085 - protein, 9 aa, Homo sapiens
LTPLYELVK

SEQ ID NO: 1086 - protein, 9 aa, Homo sapiens
KALQTEMAR

SEQ ID NO: 1087 - protein, 19 aa, Homo sapiens
FDHTNSLNIAGLSLDFSSK

SEQ ID NO: 1088 - protein, 9 aa, Homo sapiens
PLVYIQDPK

SEQ ID NO: 1089 - protein, 13 aa, Homo sapiens
ALVEQGFTVPEIK

SEQ ID NO: 1090 - protein, 21 aa, Homo sapiens
VLFYVDSEKLKQNDFNSVEEK

SEQ ID NO: 1091 - protein, 16 aa, Homo sapiens
VDSHFRQGIPFFGQVR

SEQ ID NO: 1092 - protein, 22 aa, Homo sapiens
VLFYVDSEKLKQNDFNSVEEKK

SEQ ID NO: 1093 - protein, 7 aa, Homo sapiens
FLDSNIK

SEQ ID NO: 1094 - protein, 18 aa, Homo sapiens
DHSHGPPLPQGPPPLLPM

SEQ ID NO: 1095 - protein, 15 aa, Homo sapiens
GEVQAMLGQSTEELR

SEQ ID NO: 1096 - protein, 12 aa, Homo sapiens
IADDKYNDTFWK

SEQ ID NO: 1097 - protein, 36 aa, Homo sapiens
NAAENGAIQNLIKEEAFLGITDEKTEGQFVDLTGNR

SEQ ID NO: 1098 - protein, 27 aa, Homo sapiens
VSNQTLSLFFTVLQDVPVRDLKPAIVK

SEQ ID NO: 1099 - protein, 9 aa, Homo sapiens
IPNKVIFIR

SEQ ID NO: 1100 - protein, 17 aa, Homo sapiens
RYSAWAESVTNLPQVIK

SEQ ID NO: 1101 - protein, 8 aa, Homo sapiens
VTSTLTIK

SEQ ID NO: 1102 - protein, 22 aa, Homo sapiens
LVQYRGEVQAMLGQSTEELRVR

SEQ ID NO: 1103 - protein, 9 aa, Homo sapiens
FVKVDSHFR

SEQ ID NO: 1104 - protein, 6 aa, Homo sapiens
ELEASK

SEQ ID NO: 1105 - protein, 9 aa, Homo sapiens
ATVLNYLPK

SEQ ID NO: 1106 - protein, 17 aa, Homo sapiens
LVDGKGVPIPNKVIFIR

SEQ ID NO: 1107 - protein, 20 aa, Homo sapiens
LIDQYGTHYLQSGSLGGEYR

SEQ ID NO: 1108 - protein, 6 aa, Homo sapiens
FQNLDK

SEQ ID NO: 1109 - protein, 13 aa, Homo sapiens
PNSMVVEHPEFLK

SEQ ID NO: 1110 - protein, 19 aa, Homo sapiens
HTFMGVVSLGSPSGEVSHP

SEQ ID NO: 1111 - protein, 21 aa, Homo sapiens
NVPLPVIAELPPKVSVFVPPR

SEQ ID NO: 1112 - protein, 10 aa, Homo sapiens
VDKFLEDVKK

SEQ ID NO: 1113 - protein, 15 aa, Homo sapiens
PHANEVSQKIGDNLR

SEQ ID NO: 1114 - protein, 12 aa, Homo sapiens
LKQNDFNSVEEK

SEQ ID NO: 1115 - protein, 18 aa, Homo sapiens
VSVQLEASPAFLAVPVEK

SEQ ID NO: 1116 - protein, 15 aa, Homo sapiens
LRLEPLKLHVAGNLK

SEQ ID NO: 1117 - protein, 6 aa, Homo sapiens
FIAESK

SEQ ID NO: 1118 - protein, 22 aa, Homo sapiens
SSSNEEVMFLTVQVKGPTQEFK

SEQ ID NO: 1119 - protein, 7 aa, Homo sapiens
PLYELVK

SEQ ID NO: 1120 - protein, 27 aa, Homo sapiens
EGKQVGSGVTTDQVQAEAKESGPTTYK

SEQ ID NO: 1121 - protein, 32 aa, Homo sapiens
FFSLLSGSLNSHGLELNADILGTDKINSGAHK

SEQ ID NO: 1122 - protein, 18 aa, Homo sapiens
VFSNGADLSGVTEEAPLK

SEQ ID NO: 1123 - protein, 9 aa, Homo sapiens
PGGTPTAIK

SEQ ID NO: 1124 - protein, 19 aa, Homo sapiens
VSNQTLSLFFTVLQDVPVR

SEQ ID NO: 1125 - protein, 15 aa, Homo sapiens
ELSHLPSLYDYSAYR

SEQ ID NO: 1126 - protein, 12 aa, Homo sapiens
TEGQFVDLTGNR

SEQ ID NO: 1127 - protein, 16 aa, Homo sapiens
FTNDIKDAGYPKPIFK

SEQ ID NO: 1128 - protein, 9 aa, Homo sapiens
TITKLSFVK

SEQ ID NO: 1129 - protein, 22 aa, Homo sapiens
GGGAGFISGLSYLELDNPAGNK

SEQ ID NO: 1130 - protein, 7 aa, Homo sapiens
SPLFMGK

SEQ ID NO: 1131 - protein, 18 aa, Homo sapiens
RPSTDTITVMVENSHGLR

SEQ ID NO: 1132 - protein, 12 aa, Homo sapiens
VSGFIPLKPTVK

SEQ ID NO: 1133 - protein, 13 aa, Homo sapiens
ELSYYSLEDLNNK

SEQ ID NO: 1134 - protein, 13 aa, Homo sapiens
SKAIGYLNTGYQR

SEQ ID NO: 1135 - protein, 9 aa, Homo sapiens
SSGWHFVVK

SEQ ID NO: 1136 - protein, 7 aa, Homo sapiens
GDAEAVK

SEQ ID NO: 1137 - protein, 9 aa, Homo sapiens
SGGPLIVHK

SEQ ID NO: 1138 - protein, 15 aa, Homo sapiens
DBSKBTLYLQMNSLR

SEQ ID NO: 1139 - protein, 8 aa, Homo sapiens
EQLSLLDR

SEQ ID NO: 1140 - protein, 16 aa, Homo sapiens
TYFPHFDLSHGSAQVK

SEQ ID NO: 1141 - protein, 12 aa, Homo sapiens
NLKHINIDQFVR

SEQ ID NO: 1142 - protein, 6 aa, Homo sapiens
FSLDGK

SEQ ID NO: 1143 - protein, 10 aa, Homo sapiens
GKWERPFEVK

SEQ ID NO: 1144 - protein, 8 aa, Homo sapiens
WLTFSLGK

SEQ ID NO: 1145 - protein, 9 aa, Homo sapiens
ARMEEMGSR

SEQ ID NO: 1146 - protein, 26 aa, Homo sapiens
GKWERPFEVKDTEEEDFHVDQVTTVK

SEQ ID NO: 1147 - protein, 19 aa, Homo sapiens
SYELTQPPSVSVSPGQTAR

SEQ ID NO: 1148 - protein, 12 aa, Homo sapiens
LDEVKEQVAEVR

SEQ ID NO: 1149 - protein, 10 aa, Homo sapiens
GHFSISIPVK

SEQ ID NO: 1150 - protein, 16 aa, Homo sapiens
YSAWAESVTNLPQVIK

SEQ ID NO: 1151 - protein, 19 aa, Homo sapiens
LYHSEAFTVNFGDTEEAKK

SEQ ID NO: 1152 - protein, 16 aa, Homo sapiens
EPQVYTLPPSREEMTK

SEQ ID NO: 1153 - protein, 21 aa, Homo sapiens
VFSNGADLSGVTEEAPLKLSK

SEQ ID NO: 1154 - protein, 14 aa, Homo sapiens
PDVTFELLREGETK

SEQ ID NO: 1155 - protein, 13 aa, Homo sapiens
QINDYVEKGTQGK

SEQ ID NO: 1156 - protein, 14 aa, Homo sapiens
YLAWYQQKPGQAPR

SEQ ID NO: 1157 - protein, 17 aa, Homo sapiens
TTPPMLDSDGSFFLYSK

SEQ ID NO: 1158 - protein, 12 aa, Homo sapiens
YALSHAVNNYHK

SEQ ID NO: 1159 - protein, 11 aa, Homo sapiens
KGTLTEGGTQK

SEQ ID NO: 1160 - protein, 6 aa, Homo sapiens
EIQIYK

SEQ ID NO: 1161 - protein, 13 aa, Homo sapiens
SGTSASLAISGLR

SEQ ID NO: 1162 - protein, 8 aa, Homo sapiens
LTVLSQPK

SEQ ID NO: 1163 - protein, 7 aa, Homo sapiens
EYGFQVK

SEQ ID NO: 1164 - protein, 25 aa, Homo sapiens
EDPQGDAAQKTDTSHHDQDHPTFNK

SEQ ID NO: 1165 - protein, 15 aa, Homo sapiens
TDTSHHDQDHPTFNK

SEQ ID NO: 1166 - protein, 11 aa, Homo sapiens
VFSGDGKDFYR

SEQ ID NO: 1167 - protein, 11 aa, Homo sapiens
QKLTPLYELVK

SEQ ID NO: 1168 - protein, 16 aa, Homo sapiens
VNQNLVYESGSLNFSK

SEQ ID NO: 1169 - protein, 15 aa, Homo sapiens
LQHLENELTHDIITK

SEQ ID NO: 1170 - protein, 17 aa, Homo sapiens
SVLTVVHQDWLNGKEYK

SEQ ID NO: 1171 - protein, 15 aa, Homo sapiens
LKAKLPDATPKELAK

SEQ ID NO: 1172 - protein, 13 aa, Homo sapiens
FSGSGSGTDFTLK

SEQ ID NO: 1173 - protein, 10 aa, Homo sapiens
VVFLEPQWYR

SEQ ID NO: 1174 - protein, 9 aa, Homo sapiens
LLIYDASNR

SEQ ID NO: 1175 - protein, 22 aa, Homo sapiens
GFYPSDIAVEWESNGQPENNYK

SEQ ID NO: 1176 - protein, 19 aa, Homo sapiens
VVSVLTVVHQDWLNGKEYK

SEQ ID NO: 1177 - protein, 8 aa, Homo sapiens
FLENEDRR

SEQ ID NO: 1178 - protein, 22 aa, Homo sapiens
FNKPFVFLMIEQNTKSPLFMGK

SEQ ID NO: 1179 - protein, 17 aa, Homo sapiens
LSLESLTSYFSIESSTK

SEQ ID NO: 1180 - protein, 19 aa, Homo sapiens
AAPSVTLFPPSSEELQANK

SEQ ID NO: 1181 - protein, 9 aa, Homo sapiens
LSSWVLLMK

SEQ ID NO: 1182 - protein, 18 aa, Homo sapiens
TILGTMPAFEVSLQALQK

SEQ ID NO: 1183 - protein, 14 aa, Homo sapiens
GSIQVDGEELVSGR

SEQ ID NO: 1184 - protein, 23 aa, Homo sapiens
GQPLSPEKYVTSAPMPEPQAPGR

SEQ ID NO: 1185 - protein, 18 aa, Homo sapiens
APELLGGPSVFLFPPKPK

SEQ ID NO: 1186 - protein, 10 aa, Homo sapiens
KLSSWVLLMK

SEQ ID NO: 1187 - protein, 18 aa, Homo sapiens
DIQMTQSPSTLSASVGDR

SEQ ID NO: 1188 - protein, 11 aa, Homo sapiens
YLNWYQQKPGK

SEQ ID NO: 1189 - protein, 7 aa, Homo sapiens
VAAEDWK

SEQ ID NO: 1190 - protein, 19 aa, Homo sapiens
RSSAYKWKETLFSVMPGLK

SEQ ID NO: 1191 - protein, 9 aa, Homo sapiens
FSGSLLGGK

SEQ ID NO: 1192 - protein, 15 aa, Homo sapiens
TSVSQIFHSPDLAIR

SEQ ID NO: 1193 - protein, 11 aa, Homo sapiens
ASSLESGVPSR

SEQ ID NO: 1194 - protein, 8 aa, Homo sapiens
SASLHLPK

SEQ ID NO: 1195 - protein, 22 aa, Homo sapiens
ASQSVSSSYLAWYQQKPGQAPR

SEQ ID NO: 1196 - protein, 18 aa, Homo sapiens
EIVLTQSPATLSLSPGER

SEQ ID NO: 1197 - protein, 14 aa, Homo sapiens
ITPNLAEFAFSLYR

SEQ ID NO: 1198 - protein, 12 aa, Homo sapiens
SSEDPNEDIVER

SEQ ID NO: 1199 - protein, 16 aa, Homo sapiens
FSGSNSGNTATLTISR

SEQ ID NO: 1200 - protein, 19 aa, Homo sapiens
EGKQVGSGVTTDQVQAEAK

SEQ ID NO: 1201 - protein, 18 aa, Homo sapiens
EIVMTQSPATLSVSPGER

SEQ ID NO: 1202 - protein, 10 aa, Homo sapiens
LLVVYPWTQR

SEQ ID NO: 1203 - protein, 20 aa, Homo sapiens
DSGVPDRFSGSGSGTDFTLK

SEQ ID NO: 1204 - protein, 16 aa, Homo sapiens
VVSVLTVVHQDWLNGK

SEQ ID NO: 1205 - protein, 15 aa, Homo sapiens
NYLAWYQQKPGQPPK

SEQ ID NO: 1206 - protein, 23 aa, Homo sapiens
IVDLVKELDRDTVFALVNYIFFK

SEQ ID NO: 1207 - protein, 9 aa, Homo sapiens
LLIYGATSR

SEQ ID NO: 1208 - protein, 16 aa, Homo sapiens
VSVFVPPRDGFFGNPR

SEQ ID NO: 1209 - protein, 34 aa, Homo sapiens
VDNALQSGNSQESVTEQDSKDSTYSLSSTLTLSK

SEQ ID NO: 1210 - protein, 18 aa, Homo sapiens
DVQMTQSPSSLSASVGDR

SEQ ID NO: 1211 - protein, 14 aa, Homo sapiens
VVAGVANALAHKYH

SEQ ID NO: 1212 - protein, 17 aa, Homo sapiens
SVLTVLHQDWLNGKEYK

SEQ ID NO: 1213 - protein, 10 aa, Homo sapiens
SVLGQLGITK

SEQ ID NO: 1214 - protein, 10 aa, Homo sapiens
GFSPKDVLVR

SEQ ID NO: 1215 - protein, 23 aa, Homo sapiens
ATGIPDRFSGSGSGTDFTLTISR

SEQ ID NO: 1216 - protein, 23 aa, Homo sapiens
GGGAGFISGLSYLELDNPAGNKR

SEQ ID NO: 1217 - protein, 15 aa, Homo sapiens
FNKPFVFLMIEQNTK

SEQ ID NO: 1218 - protein, 15 aa, Homo sapiens
YVTSAPMPEPQAPGR

SEQ ID NO: 1219 - protein, 16 aa, Homo sapiens
QVGSGVTTDQVQAEAK

SEQ ID NO: 1220 - protein, 8 aa, Homo sapiens
DGFFGNPR

SEQ ID NO: 1221 - protein, 17 aa, Homo sapiens
ELDRDTVFALVNYIFFK

SEQ ID NO: 1222 - protein, 14 aa, Homo sapiens
DSTYSLSSTLTLSK

SEQ ID NO: 1223 - protein, 13 aa, Homo sapiens
KLKEGMLSIMSYR

SEQ ID NO: 1224 - protein, 18 aa, Homo sapiens
EKDPQPQQLPPMDPKLLK

SEQ ID NO: 1225 - protein, 15 aa, Homo sapiens
SYDWSQITTVATFGK

SEQ ID NO: 1226 - protein, 8 aa, Homo sapiens
PPSDEQLK

SEQ ID NO: 1227 - protein, 16 aa, Homo sapiens
VVSVLTVLHQDWLNGK

SEQ ID NO: 1228 - protein, 11 aa, Homo sapiens
LVDKFLEDVKK

SEQ ID NO: 1229 - protein, 8 aa, Homo sapiens
QINDYVEK

SEQ ID NO: 1230 - protein, 11 aa, Homo sapiens
AEKDSEITFIK

SEQ ID NO: 1231 - protein, 17 aa, Homo sapiens
STNYGQAPLSLLVSYTK

SEQ ID NO: 1232 - protein, 19 aa, Homo sapiens
VVSVLTVLHQDWLNGKEYK

SEQ ID NO: 1233 - protein, 18 aa, Homo sapiens
DIQMTQSPSSLSASVGDR

SEQ ID NO: 1234 - protein, 15 aa, Homo sapiens
VFAIPPSFASIFLTK

SEQ ID NO: 1235 - protein, 20 aa, Homo sapiens
ASGVPDRFSGSGSGTDFTLK

SEQ ID NO: 1236 - protein, 10 aa, Homo sapiens
SSMDTTLILK

SEQ ID NO: 1237 - protein, 12 aa, Homo sapiens
WLQGSQELPREK

SEQ ID NO: 1238 - protein, 13 aa, Homo sapiens
VHVSEEGTEPEAM

SEQ ID NO: 1239 - protein, 19 aa, Homo sapiens
EVQLLESGGGLVQPGGSLR

SEQ ID NO: 1240 - protein, 8 aa, Homo sapiens
QIQVSWLR

SEQ ID NO: 1241 - protein, 8 aa, Homo sapiens
GQPLSPEK

SEQ ID NO: 1242 - protein, 9 aa, Homo sapiens
SAVQGPPER

SEQ ID NO: 1243 - protein, 9 aa, Homo sapiens
MFLSFPTTK

SEQ ID NO: 1244 - protein, 14 aa, Homo sapiens
FNWYVDGVEVHNAK

SEQ ID NO: 1245 - protein, 16 aa, Homo sapiens
GVALHRPDVYLLPPAR

SEQ ID NO: 1246 - protein, 18 aa, Homo sapiens
DIVMTQSPDSLAVSLGER

SEQ ID NO: 1247 - protein, 18 aa, Homo sapiens
EIVLTQSPGTLSLSPGER

SEQ ID NO: 1248 - protein, 18 aa, Homo sapiens
VSVLTVLHQDWLNGKEYK

SEQ ID NO: 1249 - protein, 9 aa, Homo sapiens
LLIYGASSR

SEQ ID NO: 1250 - protein, 9 aa, Homo sapiens
TPLTATLSK

SEQ ID NO: 1251 - protein, 9 aa, Homo sapiens
LLIYWASTR

SEQ ID NO: 1252 - protein, 12 aa, Homo sapiens
TEQWSTLPPETK

SEQ ID NO: 1253 - protein, 10 aa, Homo sapiens
LSITGTYDLK

SEQ ID NO: 1254 - protein, 17 aa, Homo sapiens
ADSSPVKAGVETTTPSK

SEQ ID NO: 1255 - protein, 15 aa, Homo sapiens
DASGATFTWTPSSGK

SEQ ID NO: 1256 - protein, 38 aa, Homo sapiens
VQWKVDNALQSGNSQESVTEQDSKDSTYSLSSTLTLSK

SEQ ID NO: 1257 - protein, 19 aa, Homo sapiens
EVQLVESGGGLVQPGGSLR

SEQ ID NO: 1258 - protein, 14 aa, Homo sapiens
SVLTVLHQDWLNGK

SEQ ID NO: 1259 - protein, 10 aa, Homo sapiens
AGVETTTPSK

SEQ ID NO: 1260 - protein, 8 aa, Homo sapiens
FPLAPSSK

SEQ ID NO: 1261 - protein, 12 aa, Homo sapiens
YAATSQVLLPSK

SEQ ID NO: 1262 - protein, 18 aa, Homo sapiens
TVAAPSVFIFPPSDEQLK

SEQ ID NO: 1263 - protein, 20 aa, Homo sapiens
QSNNKYAASSYLSLTPEQWK

SEQ ID NO: 1264 - protein, 11 aa, Homo sapiens
EPQVYTLPPSR

SEQ ID NO: 1265 - protein, 14 aa, Homo sapiens
DRLDEVKEQVAEVR

SEQ ID NO: 1266 - protein, 7 aa, Homo sapiens
YLTWASR

SEQ ID NO: 1267 - protein, 15 aa, Homo sapiens
YAASSYLSLTPEQWK

SEQ ID NO: 1268 - protein, 12 aa, Homo sapiens
GPSVFPLAPSSK

SEQ ID NO: 1269 - protein, 10 aa, Homo sapiens
HTSLGPLEAK

SEQ ID NO: 1270 - protein, 15 aa, Homo sapiens
DASGVTFTWTPSSGK

SEQ ID NO: 1271 - protein, 20 aa, Homo sapiens
VDNALQSGNSQESVTEQDSK

SEQ ID NO: 1272 - protein, 17 aa, Homo sapiens
QEPSQGTTTFAVTSILR

SEQ ID NO: 1273 - protein, 29 aa, Homo sapiens
VADALTNAVAHVDDMPNALSALSDLHAHK

SEQ ID NO: 1274 - protein, 10 aa, Homo sapiens
WLQGSQELPR

SEQ ID NO: 1275 - protein, 12 aa, Homo sapiens
VSNKALPAPIEK

SEQ ID NO: 1276 - protein, 30 aa, Homo sapiens
KVADALTNAVAHVDDMPNALSALSDLHAHK

SEQ ID NO: 1277 - protein, 19 aa, Homo sapiens
FFESFGDLSTPDAVMGNPK

SEQ ID NO: 1278 - protein, 8 aa, Homo sapiens
PSVQINFK

SEQ ID NO: 1279 - protein, 13 aa, Homo sapiens
DSQHVGHSVLTAK

SEQ ID NO: 1280 - protein, 16 aa, Homo sapiens
VLGAFSDGLAHLDNLK

SEQ ID NO: 1281 - protein, 17 aa, Homo sapiens
LSFSPSQSLPASHAHLR

SEQ ID NO: 1282 - protein, 9 aa, Homo sapiens
DSVTGTLPK

SEQ ID NO: 1283 - protein, 11 aa, Homo sapiens
PVNLPGEHGQR

SEQ ID NO: 1284 - protein, 15 aa, Homo sapiens
KVPQVSTPTLVEVSR

SEQ ID NO: 1285 - protein, 14 aa, Homo sapiens
KAADDTWEPFASGK

SEQ ID NO: 1286 - protein, 11 aa, Homo sapiens
NANFKFTDHLK

SEQ ID NO: 1287 - protein, 24 aa, Homo sapiens
RYTIAALLSPYSYSTTAVVTNPKE

SEQ ID NO: 1288 - protein, 15 aa, Homo sapiens
RHPYFYAPELLFFAK

SEQ ID NO: 1289 - protein, 23 aa, Homo sapiens
ALGISPFHEHAEVVFTANDSGPR

SEQ ID NO: 1290 - protein, 13 aa, Homo sapiens
AADDTWEPFASGK

SEQ ID NO: 1291 - protein, 23 aa, Homo sapiens
HATKTAKDALSSVQESQVAQQAR

SEQ ID NO: 1292 - protein, 20 aa, Homo sapiens
VLDAVRGSPAINVAVHVFRK

SEQ ID NO: 1293 - protein, 24 aa, Homo sapiens
ALGISPFHEHAEVVFTANDSGPRR

SEQ ID NO: 1294 - protein, 8 aa, Homo sapiens
KASPGSVR

SEQ ID NO: 1295 - protein, 28 aa, Homo sapiens
TSESGELHGLTTEEEFVEGIYKVEIDTK

SEQ ID NO: 1296 - protein, 20 aa, Homo sapiens
FFGHGAEDSLADQAANEWGR

SEQ ID NO: 1297 - protein, 13 aa, Homo sapiens
GEGTGYFVDFSVR

SEQ ID NO: 1298 - protein, 10 aa, Homo sapiens
LVNEVTEFAK

SEQ ID NO: 1299 - protein, 11 aa, Homo sapiens
PAINVAVHVFR

SEQ ID NO: 1300 - protein, 10 aa, Homo sapiens
FGLLDEDGKK

SEQ ID NO: 1301 - protein, 9 aa, Homo sapiens
KNAEELKAR

SEQ ID NO: 1302 - protein, 13 aa, Homo sapiens
GSPAINVAVHVFR

SEQ ID NO: 1303 - protein, 22 aa, Homo sapiens
GISPFHEHAEVVFTANDSGPRR

SEQ ID NO: 1304 - protein, 17 aa, Homo sapiens
VFDEFKPLVEEPQNLIK

SEQ ID NO: 1305 - protein, 14 aa, Homo sapiens
EGGREHVAHLLFLR

SEQ ID NO: 1306 - protein, 6 aa, Homo sapiens
TFELSR

SEQ ID NO: 1307 - protein, 12 aa, Homo sapiens
PAINVAVHVFRK

SEQ ID NO: 1308 - protein, 23 aa, Homo sapiens
YTIAALLSPYSYSTTAVVTNPKE

SEQ ID NO: 1309 - protein, 16 aa, Homo sapiens
YLDKTEQWSTLPPETK

SEQ ID NO: 1310 - protein, 8 aa, Homo sapiens
NAEELKAR

SEQ ID NO: 1311 - protein, 16 aa, Homo sapiens
IVSLEPAYPPVFYLNK

SEQ ID NO: 1312 - protein, 25 aa, Homo sapiens
GRTLEIPGNSDPNMIPDGDFNSYVR

SEQ ID NO: 1313 - protein, 16 aa, Homo sapiens
DALSSVQESQVAQQAR

SEQ ID NO: 1314 - protein, 22 aa, Homo sapiens
TSESGELHGLTTEEEFVEGIYK

SEQ ID NO: 1315 - protein, 15 aa, Homo sapiens
DFALLSLQVPLKDAK

SEQ ID NO: 1316 - protein, 7 aa, Homo sapiens
VEASISK

SEQ ID NO: 1317 - protein, 18 aa, Homo sapiens
GWVTDGFSSLKDYWSTVK

SEQ ID NO: 1318 - protein, 12 aa, Homo sapiens
LNMGITDLQGLR

SEQ ID NO: 1319 - protein, 22 aa, Homo sapiens
NFVASHIANILNSEELDIQDLK

SEQ ID NO: 1320 - protein, 13 aa, Homo sapiens
EELVYELNPLDHR

SEQ ID NO: 1321 - protein, 15 aa, Homo sapiens
LKAKLPDATPKELAK

SEQ ID NO: 1322 - protein, 7 aa, Homo sapiens
LSQRFPK

SEQ ID NO: 1323 - protein, 12 aa, Homo sapiens
FLVGPDGIPIMR

SEQ ID NO: 1324 - protein, 12 aa, Homo sapiens
AYSLFSYNTQGR

SEQ ID NO: 1325 - protein, 14 aa, Homo sapiens
GSPAINVAVHVFRK

SEQ ID NO: 1326 - protein, 15 aa, Homo sapiens
VLSLAQEQVGGSPEK

SEQ ID NO: 1327 - protein, 17 aa, Homo sapiens
SEAEDASLLSFMQGYMK

SEQ ID NO: 1328 - protein, 12 aa, Homo sapiens
AVMDDFAAFVEK

SEQ ID NO: 1329 - protein, 18 aa, Homo sapiens
ILTVPGHLDEMQLDIQAR

SEQ ID NO: 1330 - protein, 15 aa, Homo sapiens
AINEKLGQYASPTAK

SEQ ID NO: 1331 - protein, 15 aa, Homo sapiens
SPAGPTVVSIGGGKG

SEQ ID NO: 1332 - protein, 11 aa, Homo sapiens
QDNEILIFWSK

SEQ ID NO: 1333 - protein, 7 aa, Homo sapiens
GLESQTK

SEQ ID NO: 1334 - protein, 26 aa, Homo sapiens
VTASDPLDTLGSEGALSPGGVASLLR

SEQ ID NO: 1335 - protein, 14 aa, Homo sapiens
GPEVQLVAHSPWLK

SEQ ID NO: 1336 - protein, 9 aa, Homo sapiens
KPAITYGTR

SEQ ID NO: 1337 - protein, 24 aa, Homo sapiens
GHMLENHVERLWAYLTIQELLAKR

SEQ ID NO: 1338 - protein, 20 aa, Homo sapiens
GATDNKGPVLAWINAVSAFR

SEQ ID NO: 1339 - protein, 12 aa, Homo sapiens
ETAASLLQAGYK

SEQ ID NO: 1340 - protein, 10 aa, Homo sapiens
SDVVYTDWKK

SEQ ID NO: 1341 - protein, 12 aa, Homo sapiens
DSSTWLTAFVLK

SEQ ID NO: 1342 - protein, 32 aa, Homo sapiens
TSESGELHGLTTEEEFVEGIYKVEIDTKSYWK

SEQ ID NO: 1343 - protein, 7 aa, Homo sapiens
LGEYDLR

SEQ ID NO: 1344 - protein, 16 aa, Homo sapiens
RHPYFYAPELLFFAKR

SEQ ID NO: 1345 - protein, 9 aa, Homo sapiens
DHAVDLIQK

SEQ ID NO: 1346 - protein, 18 aa, Homo sapiens
AVGSGATFSHYYYMILSR

SEQ ID NO: 1347 - protein, 21 aa, Homo sapiens
LAPLAEDVRGNLRGNTEGLQK

SEQ ID NO: 1348 - protein, 23 aa, Homo sapiens
YVSHFETEGPHVLLYFDSVPTSR

SEQ ID NO: 1349 - protein, 13 aa, Homo sapiens
TLRVQGNDHSATR

SEQ ID NO: 1350 - protein, 12 aa, Homo sapiens
ALVQQMEQLRQK

SEQ ID NO: 1351 - protein, 6 aa, Homo sapiens
NVNFQK

SEQ ID NO: 1352 - protein, 11 aa, Homo sapiens
GLQDEDGYRMK

SEQ ID NO: 1353 - protein, 29 aa, Homo sapiens
VTASDPLDTLGSEGALSPGGVASLLRLPR

SEQ ID NO: 1354 - protein, 17 aa, Homo sapiens
AELGGHLDQQVEEFRRR

SEQ ID NO: 1355 - protein, 8 aa, Homo sapiens
TQVLHFTK

SEQ ID NO: 1356 - protein, 10 aa, Homo sapiens
ESDTSYVSLK

SEQ ID NO: 1357 - protein, 20 aa, Homo sapiens
GHGLGHGHEQQHGLGHGHKF

SEQ ID NO: 1358 - protein, 8 aa, Homo sapiens
SQILKNVR

SEQ ID NO: 1359 - protein, 9 aa, Homo sapiens
HSHESQDLR

SEQ ID NO: 1360 - protein, 17 aa, Homo sapiens
LLPHANEVSQKIGDNLR

SEQ ID NO: 1361 - protein, 15 aa, Homo sapiens
YVGGQEHFAHLLILR

SEQ ID NO: 1362 - protein, 6 aa, Homo sapiens
VEIDTK

SEQ ID NO: 1363 - protein, 21 aa, Homo sapiens
RVEPYGENFNKALVQQMEQLR

SEQ ID NO: 1364 - protein, 11 aa, Homo sapiens
DTGAALLAESR

SEQ ID NO: 1365 - protein, 12 aa, Homo sapiens
EGDFLAEGGGVR

SEQ ID NO: 1366 - protein, 19 aa, Homo sapiens
SLAELGGHLDQQVEEFRRR

SEQ ID NO: 1367 - protein, 11 aa, Homo sapiens
MMAVAADTLQR

SEQ ID NO: 1368 - protein, 9 aa, Homo sapiens
GLQDEDGYR

SEQ ID NO: 1369 - protein, 27 aa, Homo sapiens
LQETSNWLLSQQQADGSFQDLSPVIHR

SEQ ID NO: 1370 - protein, 25 aa, Homo sapiens
STQDTVIALDALSAYWIASHTTEER

SEQ ID NO: 1371 - protein, 23 aa, Homo sapiens
TLEIPGNSDPNMIPDGDFNSYVR

SEQ ID NO: 1372 - protein, 9 aa, Homo sapiens
SDVMYTDWK

SEQ ID NO: 1373 - protein, 11 aa, Homo sapiens
ADGSYAAWLSR

SEQ ID NO: 1374 - protein, 11 aa, Homo sapiens
TVMVENSHGLR

SEQ ID NO: 1375 - protein, 8 aa, Homo sapiens
EQPGVYTK

SEQ ID NO: 1376 - protein, 12 aa, Homo sapiens
KADGSYAAWLSR

SEQ ID NO: 1377 - protein, 9 aa, Homo sapiens
AEFQDALEK

SEQ ID NO: 1378 - protein, 10 aa, Homo sapiens
PDATPKELAK

SEQ ID NO: 1379 - protein, 11 aa, Homo sapiens
GQIVFMNREPK

SEQ ID NO: 1380 - protein, 22 aa, Homo sapiens
VKVEPLYELVTATDFAYSSTVR

SEQ ID NO: 1381 - protein, 7 aa, Homo sapiens
FRQELFR

SEQ ID NO: 1382 - protein, 16 aa, Homo sapiens
RHLVPGAPFLLQALVR

SEQ ID NO: 1383 - protein, 34 aa, Homo sapiens
VLRENADSLQASLRPHADELKAKIDQNVEELKGR

SEQ ID NO: 1384 - protein, 13 aa, Homo sapiens
HTDLSGKVFVFPR

SEQ ID NO: 1385 - protein, 13 aa, Homo sapiens
DEMPSPTFLTQVK

SEQ ID NO: 1386 - protein, 11 aa, Homo sapiens
DWAESTLMTQK

SEQ ID NO: 1387 - protein, 16 aa, Homo sapiens
KGKEESLDSDLYAELR

SEQ ID NO: 1388 - protein, 12 aa, Homo sapiens
EWFWDLATGTMK

SEQ ID NO: 1389 - protein, 19 aa, Homo sapiens
VLDAVRGSPAINVAVHVFR

SEQ ID NO: 1390 - protein, 25 aa, Homo sapiens
YLDKTEQWSTLPPETKDHAVDLIQK

SEQ ID NO: 1391 - protein, 13 aa, Homo sapiens
NGFKSHALQLNNR

SEQ ID NO: 1392 - protein, 10 aa, Homo sapiens
SDVMYTDWKK

SEQ ID NO: 1393 - protein, 17 aa, Homo sapiens
QFTSSTSYNRGDSTFES

SEQ ID NO: 1394 - protein, 24 aa, Homo sapiens
NILDRQDPPSVVVTSHQAPGEKKK

SEQ ID NO: 1395 - protein, 8 aa, Homo sapiens
GQIVFMNR

SEQ ID NO: 1396 - protein, 8 aa, Homo sapiens
GNTEGLQK

SEQ ID NO: 1397 - protein, 19 aa, Homo sapiens
QLGLPGPPDVPDHAAYHPF

SEQ ID NO: 1398 - protein, 9 aa, Homo sapiens
QGSFQGGFR

SEQ ID NO: 1399 - protein, 26 aa, Homo sapiens
LHLETDSLALVALGALDTALYAAGSK

SEQ ID NO: 1400 - protein, 9 aa, Homo sapiens
SHALQLNNR

SEQ ID NO: 1401 - protein, 7 aa, Homo sapiens
LVTDLTK

SEQ ID NO: 1402 - protein, 14 aa, Homo sapiens
YQYNTDVVFDSQGK

SEQ ID NO: 1403 - protein, 9 aa, Homo sapiens
YYTYLIMNK

SEQ ID NO: 1404 - protein, 17 aa, Homo sapiens
GHLFLQTDQPIYNPGQR

SEQ ID NO: 1405 - protein, 13 aa, Homo sapiens
EMSGSPASGIPVK

SEQ ID NO: 1406 - protein, 16 aa, Homo sapiens
QIRGLEEELQFSLGSK

SEQ ID NO: 1407 - protein, 20 aa, Homo sapiens
PPSGGPGFLSIERPDSRPPR

SEQ ID NO: 1408 - protein, 7 aa, Homo sapiens
EFHLHLR

SEQ ID NO: 1409 - protein, 11 aa, Homo sapiens
GEPGDPVNLLR

SEQ ID NO: 1410 - protein, 19 aa, Homo sapiens
KHNLGHGHKHERDQGHGHQ

SEQ ID NO: 1411 - protein, 26 aa, Homo sapiens
TPLPPTSAHGNVAEGETKPDPDVTER

SEQ ID NO: 1412 - protein, 13 aa, Homo sapiens
YYYDGKDYIEFNK

SEQ ID NO: 1413 - protein, 19 aa, Homo sapiens
ALEILQEEDLIDEDDIPVR

SEQ ID NO: 1414 - protein, 23 aa, Homo sapiens
RVEPYGENFNKALVQQMEQLRQK

SEQ ID NO: 1415 - protein, 8 aa, Homo sapiens
FATELHER

SEQ ID NO: 1416 - protein, 33 aa, Homo sapiens; identical to SEQ ID NO: 338

SEQ ID NO: 1417 - protein, 13 aa, Homo sapiens
ALFVSEEEKKLTR

SEQ ID NO: 1418 - protein, 22 aa, Homo sapiens
RRVEPYGENFNKALVQQMEQLR

SEQ ID NO: 1419 - protein, 20 aa, Homo sapiens
SVNDLYIQKQFPILLDFKTK

SEQ ID NO: 1420 - protein, 9 aa, Homo sapiens
KSQPMGLWR

SEQ ID NO: 1421 - protein, 14 aa, Homo sapiens
ELQQRLEPYADQLR

SEQ ID NO: 1422 - protein, 30 aa, Homo sapiens
WSTDPDKGLFISLPQLPPSAVPAEFAWTIK

SEQ ID NO: 1423 - protein, 9 aa, Homo sapiens
YRVFALDQK

SEQ ID NO: 1424 - protein, 33 aa, Homo sapiens
YSLTYIYTGLSKHVEDVPAFQALGSLNDLQFFR

SEQ ID NO: 1425 - protein, 8 aa, Homo sapiens
VEYGFQVK

SEQ ID NO: 1426 - protein, 9 aa, Homo sapiens
DAGAIAGLK

SEQ ID NO: 1427 - protein, 21 aa, Homo sapiens
QTQVSVLPEGGETPLFKQFFK

SEQ ID NO: 1428 - protein, 8 aa, Homo sapiens
LEYLLLSR

SEQ ID NO: 1429 - protein, 19 aa, Homo sapiens
PYADEFKVKIDQTVEELRR

SEQ ID NO: 1430 - protein, 9 aa, Homo sapiens
EHSSLAFWK

SEQ ID NO: 1431 - protein, 19 aa, Homo sapiens
ALFQDKLGEVNTYAGDLQK

SEQ ID NO: 1432 - protein, 11 aa, Homo sapiens
FSGTWYAMAKK

SEQ ID NO: 1433 - protein, 9 aa, Homo sapiens
VDFTLSSER

SEQ ID NO: 1434 - protein, 29 aa, Homo sapiens
YLDKTEQWSTLPPETKDHAVDLIQKGYMR

SEQ ID NO: 1435 - protein, 9 aa, Homo sapiens
HLEDVFSKR

SEQ ID NO: 1436 - protein, 22 aa, Homo sapiens
SFEGLGQLEVLTLDHNQLQEVK

SEQ ID NO: 1437 - protein, 12 aa, Homo sapiens
GQIVFMNREPKR

SEQ ID NO: 1438 - protein, 11 aa, Homo sapiens
GASQAGAPQGR

SEQ ID NO: 1439 - protein, 14 aa, Homo sapiens
YIYGKPVQGVAYVR

SEQ ID NO: 1440 - protein, 27 aa, Homo sapiens
KKEVYMPSSIFQDDFVIPDISEPGTWK

SEQ ID NO: 1441 - protein, 15 aa, Homo sapiens
VEASISKANSFLGEK

SEQ ID NO: 1442 - protein, 20 aa, Homo sapiens
AYISMHSYSQHIVFPYSYTR

SEQ ID NO: 1443 - protein, 25 aa, Homo sapiens
EVYMPSSIFQDDFVIPDISEPGTWK

SEQ ID NO: 1444 - protein, 13 aa, Homo sapiens
AKLPDATPKELAK

SEQ ID NO: 1445 - protein, 11 aa, Homo sapiens
YSPGGTPTAIK

SEQ ID NO: 1446 - protein, 10 aa, Homo sapiens
LDAQASFLPK

SEQ ID NO: 1447 - protein, 20 aa, Homo sapiens
QLVHHFEIDVDIFEPQGISK

SEQ ID NO: 1448 - protein, 13 aa, Homo sapiens
GSFEFPVGDAVSK

SEQ ID NO: 1449 - protein, 10 aa, Homo sapiens
VGDTLNLNLR

SEQ ID NO: 1450 - protein, 19 aa, Homo sapiens
EGAIHREELVYELNPLDHR

SEQ ID NO: 1451 - protein, 14 aa, Homo sapiens
SSTTKPPFKPHGSR

SEQ ID NO: 1452 - protein, 12 aa, Homo sapiens
YGKPVQGVAYVR

SEQ ID NO: 1453 - protein, 11 aa, Homo sapiens
LPDATPKELAK

SEQ ID NO: 1454 - protein, 10 aa, Homo sapiens
SFFPENWLWR

SEQ ID NO: 1455 - protein, 31 aa, Homo sapiens
EVSADQVATVMWDYFSQLSNNAKEAVEHLQK

SEQ ID NO: 1456 - protein, 11 aa, Homo sapiens
GDSGGPLIVHK

SEQ ID NO: 1457 - protein, 26 aa, Homo sapiens
LLLFSPSVVHLGVPLSVGVQLQDVPR

SEQ ID NO: 1458 - protein, 7 aa, Homo sapiens
VSMMQTK

SEQ ID NO: 1459 - protein, 25 aa, Homo sapiens
ITPGKPYILTVPGHLDEMQLDIQAR

SEQ ID NO: 1460 - protein, 10 aa, Homo sapiens
NQFNDYTSKK

SEQ ID NO: 1461 - protein, 11 aa, Homo sapiens
SEYGAALAWEK

SEQ ID NO: 1462 - protein, 12 aa, Homo sapiens
EAPKVVEEQESR

SEQ ID NO: 1463 - protein, 20 aa, Homo sapiens
QLVFHIGHGDLGSPAVLVSR

SEQ ID NO: 1464 - protein, 16 aa, Homo sapiens
EIPAWVPFDPAAQITK

SEQ ID NO: 1465 - protein, 13 aa, Homo sapiens
GLEEELQFSLGSK

SEQ ID NO: 1466 - protein, 13 aa, Homo sapiens
ARLLPHANEVSQK

SEQ ID NO: 1467 - protein, 11 aa, Homo sapiens
LPLEYSYGEYR

SEQ ID NO: 1468 - protein, 9 aa, Homo sapiens
SSLISALFR

SEQ ID NO: 1469 - protein, 19 aa, Homo sapiens
MRPSTDTITVMVENSHGLR

SEQ ID NO: 1470 - protein, 11 aa, Homo sapiens
PEHVFIHPGWK

SEQ ID NO: 1471 - protein, 20 aa, Homo sapiens
VEPYGENFNKALVQQMEQLR

SEQ ID NO: 1472 - protein, 12 aa, Homo sapiens
FVSEEEKKLTRK

SEQ ID NO: 1473 - protein, 19 aa, Homo sapiens
LDAQASFLPKELAAQTIKK

SEQ ID NO: 1474 - protein, 10 aa, Homo sapiens
AGEVQEPELR

SEQ ID NO: 1475 - protein, 14 aa, Homo sapiens
SELTQQLNALFQDK

SEQ ID NO: 1476 - protein, 13 aa, Homo sapiens
HLQAGMQAYIDIK

SEQ ID NO: 1477 - protein, 11 aa, Homo sapiens
MREWFSETFQK

SEQ ID NO: 1478 - protein, 39 aa, Homo sapiens; identical to SEQ ID NO: 316

SEQ ID NO: 1479 - protein, 25 aa, Homo sapiens
VLQIEKEGAIHREELVYELNPLDHR

SEQ ID NO: 1480 - protein, 8 aa, Homo sapiens
MFQEIVHK

SEQ ID NO: 1481 - protein, 9 aa, Homo sapiens
SHKPLNMGK

SEQ ID NO: 1482 - protein, 13 aa, Homo sapiens
LTPEHVFIHPGWK

SEQ ID NO: 1483 - protein, 18 aa, Homo sapiens
YNPVVIDFEMQPIHEVLR

SEQ ID NO: 1484 - protein, 10 aa, Homo sapiens
WEAEPVYVQR

SEQ ID NO: 1485 - protein, 10 aa, Homo sapiens
GSVFLRNPSR

SEQ ID NO: 1486 - protein, 24 aa, Homo sapiens
VDFTLSSERDFALLSLQVPLKDAK

SEQ ID NO: 1487 - protein, 10 aa, Homo sapiens
LGQYASPTAK

SEQ ID NO: 1488 - protein, 9 aa, Homo sapiens
PFLLQALVR

SEQ ID NO: 1489 - protein, 8 aa, Homo sapiens
VTGWGNLK

SEQ ID NO: 1490 - protein, 11 aa, Homo sapiens
LGQYASPTAKR

SEQ ID NO: 1491 - protein, 11 aa, Homo sapiens
PALFSGLAELR

SEQ ID NO: 1492 - protein, 6 aa, Homo sapiens
LPMSVR

SEQ ID NO: 1493 - protein, 23 aa, Homo sapiens
PGKPYILTVPGHLDEMQLDIQAR

SEQ ID NO: 1494 - protein, 25 aa, Homo sapiens
TLDLGENQLETLPPDLLRGPLQLER

SEQ ID NO: 1495 - protein, 17 aa, Homo sapiens
KFSEWGNNAFFYYFEHR

SEQ ID NO: 1496 - protein, 18 aa, Homo sapiens
RGHLFLQTDQPIYNPGQR

SEQ ID NO: 1497 - protein, 7 aa, Homo sapiens
VFALDQK

SEQ ID NO: 1498 - protein, 33 aa, Homo sapiens; identical to SEQ ID NO: 629

SEQ ID NO: 1499 - protein, 10 aa, Homo sapiens
AIHLDLEEYR

SEQ ID NO: 1500 - protein, 11 aa, Homo sapiens
TFTPQPPGLER

SEQ ID NO: 1501 - protein, 9 aa, Homo sapiens
ITQVLHFTK

SEQ ID NO: 1502 - protein, 21 aa, Homo sapiens
AEFQDALEKLNMGITDLQGLR

SEQ ID NO: 1503 - protein, 8 aa, Homo sapiens
NVAVHVFR

SEQ ID NO: 1504 - protein, 24 aa, Homo sapiens
PLLVDVDLQYPQDAVLALTQNHHK

SEQ ID NO: 1505 - protein, 20 aa, Homo sapiens
GEVLPLPEANFPSFPLPHHK

SEQ ID NO: 1506 - protein, 12 aa, Homo sapiens
VTFQLTYEEVLK

SEQ ID NO: 1507 - protein, 6 aa, Homo sapiens
VFVFPR

SEQ ID NO: 1508 - protein, 28 aa, Homo sapiens
DGWHSWPIAHQWPQGPSAVDAAFSWEEK

SEQ ID NO: 1509 - protein, 17 aa, Homo sapiens
DDDLEHQGGHVLDHGHK

SEQ ID NO: 1510 - protein, 24 aa, Homo sapiens
FIIEGMEEAGSVALEELVEKEKDR

SEQ ID NO: 1511 - protein, 20 aa, Homo sapiens
IVEGSDAEIGMSPWQVMLFR

SEQ ID NO: 1512 - protein, 35 aa, Homo sapiens
EAVEHLQKSELTQQLNALFQDKLGEVNTYAGDLQK

SEQ ID NO: 1513 - protein, 11 aa, Homo sapiens
AINVAVHVFRK

SEQ ID NO: 1514 - protein, 16 aa, Homo sapiens
TMEQFTIHLTVNPQSK

SEQ ID NO: 1515 - protein, 9 aa, Homo sapiens
MVENSHGLR

SEQ ID NO: 1516 - protein, 14 aa, Homo sapiens
LGQEQDSYGGKFDR

SEQ ID NO: 1517 - protein, 10 aa, Homo sapiens
KATVVYQGER

SEQ ID NO: 1518 - protein, 16 aa, Homo sapiens
IFYFSVPPFAYEDIAR

SEQ ID NO: 1519 - protein, 11 aa, Homo sapiens
EGGQTAPASTR

SEQ ID NO: 1520 - protein, 6 aa, Homo sapiens
VLQIEK

SEQ ID NO: 1521 - protein, 9 aa, Homo sapiens
INVAVHVFR

SEQ ID NO: 1522 - protein, 16 aa, Homo sapiens
MPMGLSTGIISDSQIK

SEQ ID NO: 1523 - protein, 14 aa, Homo sapiens
LAELPADALGPLQR

SEQ ID NO: 1524 - protein, 12 aa, Homo sapiens
DFALQNPSAVPR

SEQ ID NO: 1525 - protein, 12 aa, Homo sapiens
LVNGQSHISLSK

SEQ ID NO: 1526 - protein, 20 aa, Homo sapiens
SPFHEHAEVVFTANDSGPRR

SEQ ID NO: 1527 - protein, 7 aa, Homo sapiens
DKVTAWK

SEQ ID NO: 1528 - protein, 14 aa, Homo sapiens
DSPVLIDFFEDTER

SEQ ID NO: 1529 - protein, 21 aa, Homo sapiens
LTPYADEFKVKIDQTVEELRR

SEQ ID NO: 1530 - protein, 13 aa, Homo sapiens
NEKLGQYASPTAK

SEQ ID NO: 1531 - protein, 7 aa, Homo sapiens
TSPVDEK

SEQ ID NO: 1532 - protein, 25 aa, Homo sapiens
YSKNILDRQDPPSVVVTSHQAPGEK

SEQ ID NO: 1533 - protein, 7 aa, Homo sapiens
PYADEFK

SEQ ID NO: 1534 - protein, 14 aa, Homo sapiens
TTNIQGINLLFSSR

SEQ ID NO: 1535 - protein, 13 aa, Homo sapiens
LKEEIGKELEELR

SEQ ID NO: 1536 - protein, 11 aa, Homo sapiens
GDKVWVYPPEK

SEQ ID NO: 1537 - protein, 9 aa, Homo sapiens
YGFYTHVFR

SEQ ID NO: 1538 - protein, 9 aa, Homo sapiens
LELSVDGAK

SEQ ID NO: 1539 - protein, 7 aa, Homo sapiens
AYSDLSR

SEQ ID NO: 1540 - protein, 7 aa, Homo sapiens
VTYDVSR

SEQ ID NO: 1541 - protein, 14 aa, Homo sapiens
EWFWDLATGTMKER

SEQ ID NO: 1542 - protein, 9 aa, Homo sapiens
FKKPQSLTK

SEQ ID NO: 1543 - protein, 16 aa, Homo sapiens
DSQEEEKTEALTSAKR

SEQ ID NO: 1544 - protein, 25 aa, Homo sapiens
LTVAAPPSGGPGFLSIERPDSRPPR

SEQ ID NO: 1545 - protein, 19 aa, Homo sapiens
GSLVQASEANLQAAQDFVR

SEQ ID NO: 1546 - protein, 16 aa, Homo sapiens
VAGLLEDTFPGLLGLR

SEQ ID NO: 1547 - protein, 13 aa, Homo sapiens
TATSEYQTFFNPR

SEQ ID NO: 1548 - protein, 22 aa, Homo sapiens
PTSAHGNVAEGETKPDPDVTER

SEQ ID NO: 1549 - protein, 8 aa, Homo sapiens
PIYNPGQR

SEQ ID NO: 1550 - protein, 10 aa, Homo sapiens
QGYFVEAQPK

SEQ ID NO: 1551 - protein, 21 aa, Homo sapiens
AEATTLHVAPQGTAMAVSTFR

SEQ ID NO: 1552 - protein, 9 aa, Homo sapiens
SDLEVAHYK

SEQ ID NO: 1553 - protein, 10 aa, Homo sapiens
FVTWIEGMMR

SEQ ID NO: 1554 - protein, 14 aa, Homo sapiens
ISEGLPALEFPNEK

SEQ ID NO: 1555 - protein, 10 aa, Homo sapiens
DQNVEELKGR

SEQ ID NO: 1556 - protein, 10 aa, Homo sapiens
KYVLPNFEVK

SEQ ID NO: 1557 - protein, 23 aa, Homo sapiens
PPTSAHGNVAEGETKPDPDVTER

SEQ ID NO: 1558 - protein, 20 aa, Homo sapiens
DGSPDVTTADIGANTPDATK

SEQ ID NO: 1559 - protein, 17 aa, Homo sapiens
GEWPWQVTLHTTSPTQR

SEQ ID NO: 1560 - protein, 19 aa, Homo sapiens
QKLGPHAGDVEGHLSFLEK

SEQ ID NO: 1561 - protein, 10 aa, Homo sapiens
NHMQYEIVIK

SEQ ID NO: 1562 - protein, 38 aa, Homo sapiens; identical to SEQ ID NO: 147

SEQ ID NO: 1563 - protein, 18 aa, Homo sapiens
VPEARPNSMVVEHPEFLK

SEQ ID NO: 1564 - protein, 9 aa, Homo sapiens
VVEESELAR

SEQ ID NO: 1565 - protein, 11 aa, Homo sapiens
DIFTGLIGPMK

SEQ ID NO: 1566 - protein, 7 aa, Homo sapiens
SSGAFWK

SEQ ID NO: 1567 - protein, 21 aa, Homo sapiens
VGLSGMAIADVTLLSGFHALR

SEQ ID NO: 1568 - protein, 11 aa, Homo sapiens
LNHQLEGLTFQ

SEQ ID NO: 1569 - protein, 10 aa, Homo sapiens
EVFGQFNGKR

SEQ ID NO: 1570 - protein, 19 aa, Homo sapiens
GPEVQLVAHSPWLKDSLSR

SEQ ID NO: 1571 - protein, 9 aa, Homo sapiens
KSLEDKTER

SEQ ID NO: 1572 - protein, 28 aa, Homo sapiens
VVQGKEPAHLMSLFGGKPMIIYKGGTSR

SEQ ID NO: 1573 - protein, 19 aa, Homo sapiens
YPSLSIHGIEGAFDEPGTK

SEQ ID NO: 1574 - protein, 18 aa, Homo sapiens
ENADSLQASLRPHADELK

SEQ ID NO: 1575 - protein, 24 aa, Homo sapiens
QGHNSVFLIKGDKVWVYPPEKKEK

SEQ ID NO: 1576 - protein, 13 aa, Homo sapiens
YGDSGEQIAGFVK

SEQ ID NO: 1577 - protein, 15 aa, Homo sapiens
MEEVEAMLLPETLKR

SEQ ID NO: 1578 - protein, 21 aa, Homo sapiens
TSAHGNVAEGETKPDPDVTER

SEQ ID NO: 1579 - protein, 13 aa, Homo sapiens
IVLGQEQDSYGGK

SEQ ID NO: 1580 - protein, 16 aa, Homo sapiens
SKMLTPEHVFIHPGWK

SEQ ID NO: 1581 - protein, 11 aa, Homo sapiens
ALEQDLPVNIK

SEQ ID NO: 1582 - protein, 15 aa, Homo sapiens
LYLVQGTQVYVFLTK

SEQ ID NO: 1583 - protein, 6 aa, Homo sapiens
YSDLSR

SEQ ID NO: 1584 - protein, 20 aa, Homo sapiens
KPDVSHGEMVSGFGPIYNYK

SEQ ID NO: 1585 - protein, 21 aa, Homo sapiens
KGEVLPLPEANFPSFPLPHHK

SEQ ID NO: 1586 - protein, 26 aa, Homo sapiens
VGLSGMAIADVTLLSGFHALRADLEK

SEQ ID NO: 1587 - protein, 42 aa, Homo sapiens; identical to SEQ ID NO: 89

SEQ ID NO: 1588 - protein, 14 aa, Homo sapiens
DLHFLEELQLGHNR

SEQ ID NO: 1589 - protein, 33 aa, Homo sapiens; identical to SEQ ID NO: 137

SEQ ID NO: 1590 - protein, 9 aa, Homo sapiens
PVQGVAYVR

SEQ ID NO: 1591 - protein, 16 aa, Homo sapiens
YQIWTTVVDWIHPDLK

SEQ ID NO: 1592 - protein, 11 aa, Homo sapiens
PLAEDVRGNLR

SEQ ID NO: 1593 - protein, 15 aa, Homo sapiens
HLVPGAPFLLQALVR

SEQ ID NO: 1594 - protein, 32 aa, Homo sapiens; identical to SEQ ID NO: 52

SEQ ID NO: 1595 - protein, 8 aa, Homo sapiens
ELAAQTIK

SEQ ID NO: 1596 - protein, 22 aa, Homo sapiens
LAKDSEKLKEEIGKELEELRAR

SEQ ID NO: 1597 - protein, 23 aa, Homo sapiens
NILDRQDPPSVVVTSHQAPGEKK

SEQ ID NO: 1598 - protein, 8 aa, Homo sapiens
IPFFGQVR

SEQ ID NO: 1599 - protein, 9 aa, Homo sapiens
RQLTPYAQR

SEQ ID NO: 1600 - protein, 14 aa, Homo sapiens
FGLLDEDGKKTFFR

SEQ ID NO: 1601 - protein, 12 aa, Homo sapiens
LSHNAIASLRPR

SEQ ID NO: 1602 - protein, 9 aa, Homo sapiens
PVRGEVPPR

SEQ ID NO: 1603 - protein, 29 aa, Homo sapiens
YYYDGKDYIEFNKEIPAWVPFDPAAQITK

SEQ ID NO: 1604 - protein, 20 aa, Homo sapiens
IYEDHDATQQLQGFYSQVAK

SEQ ID NO: 1605 - protein, 8 aa, Homo sapiens
SQPMGLWR

SEQ ID NO: 1606 - protein, 15 aa, Homo sapiens
QKISEGLPALEFPNE

SEQ ID NO: 1607 - protein, 13 aa, Homo sapiens
GLRQGYFVEAQPK

SEQ ID NO: 1608 - protein, 9 aa, Homo sapiens
GSEMVVAGK

SEQ ID NO: 1609 - protein, 12 aa, Homo sapiens
ITQVLHFTKDVK

SEQ ID NO: 1610 - protein, 11 aa, Homo sapiens
AREDIFMETLK

SEQ ID NO: 1611 - protein, 15 aa, Homo sapiens
LSEKHEGSFIQGAEK

SEQ ID NO: 1612 - protein, 20 aa, Homo sapiens
TPYADEFKVKIDQTVEELRR

SEQ ID NO: 1613 - protein, 9 aa, Homo sapiens
LVWEEAMSR

SEQ ID NO: 1614 - protein, 22 aa, Homo sapiens
VANYFDWISYHVGRPFISQYNV

SEQ ID NO: 1615 - protein, 9 aa, Homo sapiens
LSMDGSPTR

SEQ ID NO: 1616 - protein, 24 aa, Homo sapiens
FQILTLWLPDSLTTWEIHGLSLSK

SEQ ID NO: 1617 - protein, 15 aa, Homo sapiens
NLIAAVAPGAFLGLK

SEQ ID NO: 1618 - protein, 8 aa, Homo sapiens
VVVHPDYR

SEQ ID NO: 1619 - protein, 10 aa, Homo sapiens
AFWLDVSHNR

SEQ ID NO: 1620 - protein, 17 aa, Homo sapiens
DSEKLKEEIGKELEELR

SEQ ID NO: 1621 - protein, 14 aa, Homo sapiens
DLRDKVNSFFSTFK

SEQ ID NO: 1622 - protein, 8 aa, Homo sapiens
QLTPYAQR

SEQ ID NO: 1623 - protein, 12 aa, Homo sapiens
EEFWLGLDNLNK

SEQ ID NO: 1624 - protein, 17 aa, Homo sapiens
VFQYIDLHQDEFVQTLK

SEQ ID NO: 1625 - protein, 10 aa, Homo sapiens
IADNKQSSFK

SEQ ID NO: 1626 - protein, 8 aa, Homo sapiens
FWTSFFPK

SEQ ID NO: 1627 - protein, 13 aa, Homo sapiens
VFVIDKSGSMSGR

SEQ ID NO: 1628 - protein, 10 aa, Homo sapiens
PKVVEEQESR

SEQ ID NO: 1629 - protein, 13 aa, Homo sapiens
KAAISGENAGLVR

SEQ ID NO: 1630 - protein, 17 aa, Homo sapiens
LGPHAGDVEGHLSFLEK

SEQ ID NO: 1631 - protein, 17 aa, Homo sapiens
FQGDREWFWDLATGTMK

SEQ ID NO: 1632 - protein, 18 aa, Homo sapiens
RITEVWGIPSPIDTVFTR

SEQ ID NO: 1633 - protein, 23 aa, Homo sapiens
DYIEFNKEIPAWVPFDPAAQITK

SEQ ID NO: 1634 - protein, 15 aa, Homo sapiens
LFQGLGKLEYLLLSR

SEQ ID NO: 1635 - protein, 8 aa, Homo sapiens
FLQEQGHR

SEQ ID NO: 1636 - protein, 13 aa, Homo sapiens
LWAYLTIQELLAK

SEQ ID NO: 1637 - protein, 14 aa, Homo sapiens
VANYFDWISYHVGR

SEQ ID NO: 1638 - protein, 12 aa, Homo sapiens
SIEVFGQFNGKR

SEQ ID NO: 1639 - protein, 13 aa, Homo sapiens
VQFELHYQEVKWR

SEQ ID NO: 1640 - protein, 39 aa, Homo sapiens
FDPAKLDQIESVITATSANTQLVLETLAQMDDLQDFLSK

SEQ ID NO: 1641 - protein, 9 aa, Homo sapiens
REQPGVYTK

SEQ ID NO: 1642 - protein, 10 aa, Homo sapiens
YLTLNTESTR

SEQ ID NO: 1643 - protein, 15 aa, Homo sapiens
ALRDFALQNPSAVPR

SEQ ID NO: 1644 - protein, 13 aa, Homo sapiens
GQEQDSYGGKFDR

SEQ ID NO: 1645 - protein, 7 aa, Homo sapiens
LSNDRIR

SEQ ID NO: 1646 - protein, 20 aa, Homo sapiens
SVVLIPLGAVDDGEHSQNEK

SEQ ID NO: 1647 - protein, 9 aa, Homo sapiens
ATVVYQGER

SEQ ID NO: 1648 - protein, 9 aa, Homo sapiens
VKENFDKAR

SEQ ID NO: 1649 - protein, 19 aa, Homo sapiens
PSGGPGFLSIERPDSRPPR

SEQ ID NO: 1650 - protein, 29 aa, Homo sapiens
GRFPLYNLGFGHNVDFNFLEVMSMENNGR

SEQ ID NO: 1651 - protein, 16 aa, Homo sapiens
FSEWGNNAFFYYFEHR

SEQ ID NO: 1652 - protein, 10 aa, Homo sapiens
PDISEPGTWK

SEQ ID NO: 1653 - protein, 8 aa, Homo sapiens
WLDLSHNR

SEQ ID NO: 1654 - protein, 20 aa, Homo sapiens
LEPYADQLRTQVNTQAEQLR

SEQ ID NO: 1655 - protein, 9 aa, Homo sapiens
ELAAQTIKK

SEQ ID NO: 1656 - protein, 6 aa, Homo sapiens
HLMAGR

SEQ ID NO: 1657 - protein, 18 aa, Homo sapiens
GSWVNKFPVEMTHNHNFR

SEQ ID NO: 1658 - protein, 15 aa, Homo sapiens
VAEGETKPDPDVTER

SEQ ID NO: 1659 - protein, 9 aa, Homo sapiens
SSFVAPLEK

SEQ ID NO: 1660 - protein, 26 aa, Homo sapiens
TIVRFNRPFLMIIVPTDTQNIFFMSK

SEQ ID NO: 1661 - protein, 19 aa, Homo sapiens
DDPDAPLQPVTPLQLFEGR

SEQ ID NO: 1662 - protein, 7 aa, Homo sapiens
PYADQLR

SEQ ID NO: 1663 - protein, 9 aa, Homo sapiens
QFPILLDFK

SEQ ID NO: 1664 - protein, 19 aa, Homo sapiens
ILGDMQPGDYFDLVLFGTR

SEQ ID NO: 1665 - protein, 21 aa, Homo sapiens
GISPFHEHAEVVFTANDSGPR

SEQ ID NO: 1666 - protein, 25 aa, Homo sapiens
RAEVSADQVATVMWDYFSQLSNNAK

SEQ ID NO: 1667 - protein, 16 aa, Homo sapiens
EQLQDMGLVDLFSPEK

SEQ ID NO: 1668 - protein, 15 aa, Homo sapiens
IPGIFELGISSQSDR

SEQ ID NO: 1669 - protein, 11 aa, Homo sapiens
EKGEIQNILQK

SEQ ID NO: 1670 - protein, 12 aa, Homo sapiens
KEEIGKELEELR

SEQ ID NO: 1671 - protein, 17 aa, Homo sapiens
VLSALQAVQGLLVAQGR

SEQ ID NO: 1672 - protein, 10 aa, Homo sapiens
EMEDTLNHLK

SEQ ID NO: 1673 - protein, 17 aa, Homo sapiens
TFKDLHFLEELQLGHNR

SEQ ID NO: 1674 - protein, 9 aa, Homo sapiens
YNWRENLDR

SEQ ID NO: 1675 - protein, 10 aa, Homo sapiens
EVAFDLEIPK

SEQ ID NO: 1676 - protein, 13 aa, Homo sapiens
AKIDQNVEELKGR

SEQ ID NO: 1677 - protein, 16 aa, Homo sapiens
AELGGHLDQQVEEFRR

SEQ ID NO: 1678 - protein, 11 aa, Homo sapiens
DKVNSFFSTFK

SEQ ID NO: 1679 - protein, 18 aa, Homo sapiens
FAHYVVTSQVVNTANEAR

SEQ ID NO: 1680 - protein, 7 aa, Homo sapiens
KYAFELK

SEQ ID NO: 1681 - protein, 15 aa, Homo sapiens
NRDVVLTTTFVDDIK

SEQ ID NO: 1682 - protein, 20 aa, Homo sapiens
AYSLFSYNTQGRDNELLVYK

SEQ ID NO: 1683 - protein, 22 aa, Homo sapiens
PYAQDTQEKLNHQLEGLTFQMK

SEQ ID NO: 1684 - protein, 29 aa, Homo sapiens
NLAVSQVVHKAVLDVFEEGTEASAATAVK

SEQ ID NO: 1685 - protein, 36 aa, Homo sapiens; identical to SEQ ID NO: 293

SEQ ID NO: 1686 - protein, 9 aa, Homo sapiens
TKNDFTWFK

SEQ ID NO: 1687 - protein, 8 aa, Homo sapiens
GFYTHVFR

SEQ ID NO: 1688 - protein, 33 aa, Homo sapiens; identical to SEQ ID NO: 372

SEQ ID NO: 1689 - protein, 19 aa, Homo sapiens
KSLEDKTERELLESYIDGR

SEQ ID NO: 1690 - protein, 13 aa, Homo sapiens
AEMADQASAWLTR

SEQ ID NO: 1691 - protein, 28 aa, Homo sapiens
GMADQDGLKPTIDKPSEDSPPLEMLGPR

SEQ ID NO: 1692 - protein, 22 aa, Homo sapiens
QKLGPHAGDVEGHLSFLEKDLR

SEQ ID NO: 1693 - protein, 19 aa, Homo sapiens
ERPGVYTNVVEYVDWILEK

SEQ ID NO: 1694 - protein, 8 aa, Homo sapiens
NLPEQVFR

SEQ ID NO: 1695 - protein, 10 aa, Homo sapiens
MYYSAVDPTK

SEQ ID NO: 1696 - protein, 7 aa, Homo sapiens
LHIMAGR

SEQ ID NO: 1697 - protein, 24 aa, Homo sapiens
VQSWKGSLVQASEANLQAAQDFVR

SEQ ID NO: 1698 - protein, 17 aa, Homo sapiens
QDPPSVVVTSHQAPGEK

SEQ ID NO: 1699 - protein, 13 aa, Homo sapiens
EKAGFSWIEVTFK

SEQ ID NO: 1700 - protein, 9 aa, Homo sapiens
PYADEFKVK

SEQ ID NO: 1701 - protein, 21 aa, Homo sapiens
APPSGGPGFLSIERPDSRPPR

SEQ ID NO: 1702 - protein, 25 aa, Homo sapiens
SLAPYAQDTQEKLNHQLEGLTFQMK

SEQ ID NO: 1703 - protein, 13 aa, Homo sapiens
LAPLAEDVRGNLR

SEQ ID NO: 1704 - protein, 11 aa, Homo sapiens
GKPVQGVAYVR

SEQ ID NO: 1705 - protein, 16 aa, Homo sapiens
GGSIQQYIYKQEPVQK

SEQ ID NO: 1706 - protein, 30 aa, Homo sapiens; identical to SEQ ID NO: 98

SEQ ID NO: 1707 - protein, 10 aa, Homo sapiens
SLAPTAAAKR

SEQ ID NO: 1708 - protein, 29 aa, Homo sapiens
GPEEEHLGILGPVIWAEVGDTIRVTFHNK

SEQ ID NO: 1709 - protein, 10 aa, Homo sapiens
PFDPAAQITK

SEQ ID NO: 1710 - protein, 22 aa, Homo sapiens
VREYYFAEAQIADFSDPAFISK

SEQ ID NO: 1711 - protein, 19 aa, Homo sapiens
VVAQGVGIPEDSIFTMADR

SEQ ID NO: 1712 - protein, 19 aa, Homo sapiens
AHGNVAEGETKPDPDVTER

SEQ ID NO: 1713 - protein, 11 aa, Homo sapiens
QEMSKDLEEVK

SEQ ID NO: 1714 - protein, 15 aa, Homo sapiens
LPLEYSYGEYRDLFR

SEQ ID NO: 1715 - protein, 28 aa, Homo sapiens
KDDIMLDEGMLQSLMELPDQYNYGMYAK

SEQ ID NO: 1716 - protein, 14 aa, Homo sapiens
IAYGTQGSSGYSLR

SEQ ID NO: 1717 - protein, 18 aa, Homo sapiens
SVNDLYIQKQFPILLDFK

SEQ ID NO: 1718 - protein, 20 aa, Homo sapiens
VAVPPLTEEDVLFNVNSDTR

SEQ ID NO: 1719 - protein, 32 aa, Homo sapiens
VPFDAATLHTSTAMAAQHGMDDDGTGQKQIWR

SEQ ID NO: 1720 - protein, 13 aa, Homo sapiens
LGEVNTYAGDLQK

SEQ ID NO: 1721 - protein, 13 aa, Homo sapiens
KAALKTASDFITK

SEQ ID NO: 1722 - protein, 25 aa, Homo sapiens
ELTPEVLQEWLDELEEMMLVVHMPR

SEQ ID NO: 1723 - protein, 15 aa, Homo sapiens
FTVDRPFLFLIYEHR

SEQ ID NO: 1724 - protein, 12 aa, Homo sapiens
AAISGENAGLVR

SEQ ID NO: 1725 - protein, 24 aa, Homo sapiens
LPPTSAHGNVAEGETKPDPDVTER

SEQ ID NO: 1726 - protein, 16 aa, Homo sapiens
ENQLEVLEVSWLHGLK

SEQ ID NO: 1727 - protein, 13 aa, Homo sapiens
ISEGLPALEFPNE

SEQ ID NO: 1728 - protein, 11 aa, Homo sapiens
YIETDPANRDR

SEQ ID NO: 1729 - protein, 20 aa, Homo sapiens
ESILFHYTDWVDDQRPENYR

SEQ ID NO: 1730 - protein, 11 aa, Homo sapiens
TFFFKDSQYWR

SEQ ID NO: 1731 - protein, 15 aa, Homo sapiens
MGNFPWQVFTNIHGR

SEQ ID NO: 1732 - protein, 10 aa, Homo sapiens
NNANGVDLNR

SEQ ID NO: 1733 - protein, 9 aa, Homo sapiens
LTPYADEFK

SEQ ID NO: 1734 - protein, 20 aa, Homo sapiens
ENADSLQASLRPHADELKAK

SEQ ID NO: 1735 - protein, 13 aa, Homo sapiens
VTFQLTYEEVLKR

SEQ ID NO: 1736 - protein, 12 aa, Homo sapiens
TEHYEEQIEAFK

SEQ ID NO: 1737 - protein, 9 aa, Homo sapiens
SVNDLYIQK

SEQ ID NO: 1738 - protein, 12 aa, Homo sapiens
SLAPYAQDTQEK

SEQ ID NO: 1739 - protein, 15 aa, Homo sapiens
YNWRENLDRDIALMK

SEQ ID NO: 1740 - protein, 13 aa, Homo sapiens
FEGHFDGVPVISK

SEQ ID NO: 1741 - protein, 21 aa, Homo sapiens
KPFVSFEQNDQPKSGENGLNK

SEQ ID NO: 1742 - protein, 8 aa, Homo sapiens
GPLDQLEK

SEQ ID NO: 1743 - protein, 22 aa, Homo sapiens
AQPVQVAEGSEPDGFWEALGGK

SEQ ID NO: 1744 - protein, 35 aa, Homo sapiens
QKLGPHAGDVEGHLSFLEKDLRDKVNSFFSTFKEK

SEQ ID NO: 1745 - protein, 11 aa, Homo sapiens
GSKGPLDQLEK

SEQ ID NO: 1746 - protein, 13 aa, Homo sapiens
EGETKPDPDVTER

SEQ ID NO: 1747 - protein, 10 aa, Homo sapiens
VFREFHLHLR

SEQ ID NO: 1748 - protein, 15 aa, Homo sapiens
ELGGHLDQQVEEFRR

SEQ ID NO: 1749 - protein, 9 aa, Homo sapiens
AKLPDATPK

SEQ ID NO: 1750 - protein, 10 aa, Homo sapiens
VGEYSLYIGR

SEQ ID NO: 1751 - protein, 7 aa, Homo sapiens
ATELHER

SEQ ID NO: 1752 - protein, 30 aa, Homo sapiens
IEGSNKVPVDPATYGQFYGGDSYIILYNYR

SEQ ID NO: 1753 - protein, 18 aa, Homo sapiens
FNAVLTNPQGDYDTSTGK

SEQ ID NO: 1754 - protein, 16 aa, Homo sapiens
PGPPDVPDHAAYHPFR

SEQ ID NO: 1755 - protein, 17 aa, Homo sapiens
GHYFWMLSPFSPPSPAR

SEQ ID NO: 1756 - protein, 13 aa, Homo sapiens
IIPHHNYNAAINK

SEQ ID NO: 1757 - protein, 10 aa, Homo sapiens
SSALDMENFR

SEQ ID NO: 1758 - protein, 14 aa, Homo sapiens
TFEGHFDGVPVISK

SEQ ID NO: 1759 - protein, 10 aa, Homo sapiens
VPFATELHER

SEQ ID NO: 1760 - protein, 12 aa, Homo sapiens
YSLTYIYTGLSK

SEQ ID NO: 1761 - protein, 11 aa, Homo sapiens
SSQESYAHGTK

SEQ ID NO: 1762 - protein, 21 aa, Homo sapiens
IVEGSDAEIGMSPWQVMLFRK

SEQ ID NO: 1763 - protein, 12 aa, Homo sapiens
TPEHVFIHPGWK

SEQ ID NO: 1764 - protein, 16 aa, Homo sapiens
QGDREWFWDLATGTMK

SEQ ID NO: 1765 - protein, 9 aa, Homo sapiens
MATTMIQSK

SEQ ID NO: 1766 - protein, 11 aa, Homo sapiens
AGFSWIEVTFK

SEQ ID NO: 1767 - protein, 8 aa, Homo sapiens
LPVAPLRK

SEQ ID NO: 1768 - protein, 13 aa, Homo sapiens
LNHQLEGLTFQMK

SEQ ID NO: 1769 - protein, 13 aa, Homo sapiens
QAVDTAVDGVFIR

SEQ ID NO: 1770 - protein, 21 aa, Homo sapiens
VLRENADSLQASLRPHADELK

SEQ ID NO: 1771 - protein, 26 aa, Homo sapiens
GTVIDVTDFVNWASSINDAPVLISQK

SEQ ID NO: 1772 - protein, 13 aa, Homo sapiens
AQLGDLPWQVAIK

SEQ ID NO: 1773 - protein, 15 aa, Homo sapiens
SLPVSDSVLSGFEQR

SEQ ID NO: 1774 - protein, 7 aa, Homo sapiens
VPPRYPR

SEQ ID NO: 1775 - protein, 12 aa, Homo sapiens
GDSGGPLIVHKR

SEQ ID NO: 1776 - protein, 9 aa, Homo sapiens
VNSFFSTFK

SEQ ID NO: 1777 - protein, 20 aa, Homo sapiens
LAKDSEKLKEEIGKELEELR

SEQ ID NO: 1778 - protein, 17 aa, Homo sapiens
SLAELGGHLDQQVEEFR

SEQ ID NO: 1779 - protein, 9 aa, Homo sapiens
ISASAEELR

SEQ ID NO: 1780 - protein, 16 aa, Homo sapiens
GPHAGDVEGHLSFLEK

SEQ ID NO: 1781 - protein, 6 aa, Homo sapiens
TAGLVR

SEQ ID NO: 1782 - protein, 8 aa, Homo sapiens
EAVEHLQK

SEQ ID NO: 1783 - protein, 9 aa, Homo sapiens
GGPLIVHKR

SEQ ID NO: 1784 - protein, 17 aa, Homo sapiens
GNVAEGETKPDPDVTER

SEQ ID NO: 1785 - protein, 12 aa, Homo sapiens
ERGHMLENHVER

SEQ ID NO: 1786 - protein, 11 aa, Homo sapiens
GGYTLVSGYPK

SEQ ID NO: 1787 - protein, 16 aa, Homo sapiens
QVEGMEDWKQDSQLQK

SEQ ID NO: 1788 - protein, 9 aa, Homo sapiens
NENHGIAQR

SEQ ID NO: 1789 - protein, 11 aa, Homo sapiens
PHHNYNAAINK

SEQ ID NO: 1790 - protein, 13 aa, Homo sapiens
GGHLDQQVEEFRR

SEQ ID NO: 1791 - protein, 22 aa, Homo sapiens
SLALGTFAHTPALASLGLSNNR

SEQ ID NO: 1792 - protein, 12 aa, Homo sapiens
VSEGNHDIALIK

SEQ ID NO: 1793 - protein, 16 aa, Homo sapiens
EQQDSPGNKDFLQSLK

SEQ ID NO: 1794 - protein, 19 aa, Homo sapiens
SSNNPHSPIVEEFQVPYNK

SEQ ID NO: 1795 - protein, 10 aa, Homo sapiens
FSGTWYAMAK

SEQ ID NO: 1796 - protein, 13 aa, Homo sapiens
RPWNVASLIYETK

SEQ ID NO: 1797 - protein, 16 aa, Homo sapiens
IVLGQEQDSYGGKFDR

SEQ ID NO: 1798 - protein, 18 aa, Homo sapiens
SLEDKTERELLESYIDGR

SEQ ID NO: 1799 - protein, 9 aa, Homo sapiens
PFATELHER

SEQ ID NO: 1800 - protein, 9 aa, Homo sapiens
PHANEVSQK

SEQ ID NO: 1801 - protein, 12 aa, Homo sapiens
KFYNQVSTPLLR

SEQ ID NO: 1802 - protein, 12 aa, Homo sapiens
GNLRGNTEGLQK

SEQ ID NO: 1803 - protein, 15 aa, Homo sapiens
AEDHFSVIDFNQNIR

SEQ ID NO: 1804 - protein, 10 aa, Homo sapiens
NIAAFGGNPK

SEQ ID NO: 1805 - protein, 26 aa, Homo sapiens
RSLAPYAQDTQEKLNHQLEGLTFQMK

SEQ ID NO: 1806 - protein, 17 aa, Homo sapiens
SNALDIIFQTDLTGQKK

SEQ ID NO: 1807 - protein, 41 aa, Homo sapiens; identical to SEQ ID NO: 356

SEQ ID NO: 1808 - protein, 12 aa, Homo sapiens
GPDVLTATVSGK

SEQ ID NO: 1809 - protein, 12 aa, Homo sapiens
RPASPISTIQPK

SEQ ID NO: 1810 - protein, 13 aa, Homo sapiens
HGNTDSEGIVEVK

SEQ ID NO: 1811 - protein, 28 aa, Homo sapiens
TAFISDFAVTADGNAFIGDIKDKVTAWK

SEQ ID NO: 1812 - protein, 16 aa, Homo sapiens
LQDRGPDVLTATVSGK

SEQ ID NO: 1813 - protein, 11 aa, Homo sapiens
RVEPYGENFNK

SEQ ID NO: 1814 - protein, 11 aa, Homo sapiens
SGYFLSISDSK

SEQ ID NO: 1815 - protein, 25 aa, Homo sapiens
IFELFEVGFLSPATFTVYEYHRPDK

SEQ ID NO: 1816 - protein, 12 aa, Homo sapiens
RRVEPYGENFNK

SEQ ID NO: 1817 - protein, 10 aa, Homo sapiens
FPSPVDAAFR

SEQ ID NO: 1818 - protein, 32 aa, Homo sapiens
DSLDQLVGGVPVTLNAQTIDVNQETSDLDPSK

SEQ ID NO: 1819 - protein, 10 aa, Homo sapiens
TEVNVLPGAK

SEQ ID NO: 1820 - protein, 20 aa, Homo sapiens
QLGLPGPPDVPDHAAYHPFR

SEQ ID NO: 1821 - protein, 10 aa, Homo sapiens
SNENHGIAQR

SEQ ID NO: 1822 - protein, 12 aa, Homo sapiens
RLPLEYSYGEYR

SEQ ID NO: 1823 - protein, 11 aa, Homo sapiens
SEGNHDIALIK

SEQ ID NO: 1824 - protein, 11 aa, Homo sapiens
QFPILLDFKTK

SEQ ID NO: 1825 - protein, 20 aa, Homo sapiens
LDRQDPPSVVVTSHQAPGEK

SEQ ID NO: 1826 - protein, 22 aa, Homo sapiens
TGLLLLSDPDKVTIGLLFWDGR

SEQ ID NO: 1827 - protein, 7 aa, Homo sapiens
IDVHWTR

SEQ ID NO: 1828 - protein, 21 aa, Homo sapiens
MYYSAVDPTKDIFTGLIGPMK

SEQ ID NO: 1829 - protein, 21 aa, Homo sapiens
HVEDVPAFQALGSLNDLQFFR

SEQ ID NO: 1830 - protein, 25 aa, Homo sapiens
NWRDPDQTDGLGLSYLSSHIANVER

SEQ ID NO: 1831 - protein, 8 aa, Homo sapiens
APLAEDVR

SEQ ID NO: 1832 - protein, 10 aa, Homo sapiens
YWGVASFLQK

SEQ ID NO: 1833 - protein, 9 aa, Homo sapiens
VWVYPPEKK

SEQ ID NO: 1834 - protein, 22 aa, Homo sapiens
NILDRQDPPSVVVTSHQAPGEK

SEQ ID NO: 1835 - protein, 27 aa, Homo sapiens
SELTQQLNALFQDKLGEVNTYAGDLQK

SEQ ID NO: 1836 - protein, 15 aa, Homo sapiens
LGNFPWQAFTSIHGR

SEQ ID NO: 1837 - protein, 32 aa, Homo sapiens; identical to SEQ ID NO: 709

SEQ ID NO: 1838 - protein, 23 aa, Homo sapiens
VLRENADSLQASLRPHADELKAK

SEQ ID NO: 1839 - protein, 19 aa, Homo sapiens
EPLDDYVNTQGASLFSVTK

SEQ ID NO: 1840 - protein, 9 aa, Homo sapiens
GHNSVFLIK

SEQ ID NO: 1841 - protein, 14 aa, Homo sapiens
LELHVDGPPPRPQL

SEQ ID NO: 1842 - protein, 10 aa, Homo sapiens
QGHNSVFLIK

SEQ ID NO: 1843 - protein, 14 aa, Homo sapiens
SRLDTLAQEVALLK

SEQ ID NO: 1844 - protein, 21 aa, Homo sapiens
STEATQWRPSLVPASAENVNK

SEQ ID NO: 1845 - protein, 16 aa, Homo sapiens
SGAQATWTELPWPHEK

SEQ ID NO: 1846 - protein, 9 aa, Homo sapiens
WDRELISER

SEQ ID NO: 1847 - protein, 16 aa, Homo sapiens
VQEAHLTEDQIFYFPK

SEQ ID NO: 1848 - protein, 11 aa, Homo sapiens
LSNENHGIAQR

SEQ ID NO: 1849 - protein, 11 aa, Homo sapiens
LVPFATELHER

SEQ ID NO: 1850 - protein, 9 aa, Homo sapiens
DGYLFQLLR

SEQ ID NO: 1851 - protein, 11 aa, Homo sapiens
IDQNVEELKGR

SEQ ID NO: 1852 - protein, 8 aa, Homo sapiens
ASYGVKPR

SEQ ID NO: 1853 - protein, 17 aa, Homo sapiens
YQIWTTVVDWIHPDLKR

SEQ ID NO: 1854 - protein, 19 aa, Homo sapiens
VVNNSPQPQNVVFDVQIPK

SEQ ID NO: 1855 - protein, 11 aa, Homo sapiens
DKVWVYPPEKK

SEQ ID NO: 1856 - protein, 9 aa, Homo sapiens
LEPYADQLR

SEQ ID NO: 1857 - protein, 8 aa, Homo sapiens
KLGSYEHR

SEQ ID NO: 1858 - protein, 11 aa, Homo sapiens
LTPYADEFKVK

SEQ ID NO: 1859 - protein, 12 aa, Homo sapiens
MKYWGVASFLQK

SEQ ID NO: 1860 - protein, 11 aa, Homo sapiens
ISASAEELRQR

SEQ ID NO: 1861 - protein, 15 aa, Homo sapiens
IQPSGGTNINEALLR

SEQ ID NO: 1862 - protein, 10 aa, Homo sapiens
GHMLENHVER

SEQ ID NO: 1863 - protein, 10 aa, Homo sapiens
ALVQQMEQLR

SEQ ID NO: 1864 - protein, 18 aa, Homo sapiens
SLAELGGHLDQQVEEFRR

SEQ ID NO: 1865 - protein, 14 aa, Homo sapiens
KVTYTSQEDLVEKK

SEQ ID NO: 1866 - protein, 12 aa, Homo sapiens
VKIDQTVEELRR

SEQ ID NO: 1867 - protein, 12 aa, Homo sapiens
GDKVWVYPPEKK

SEQ ID NO: 1868 - protein, 13 aa, Homo sapiens
IYGNQDTSSQLKK

SEQ ID NO: 1869 - protein, 11 aa, Homo sapiens
LLPHANEVSQK

SEQ ID NO: 1870 - protein, 13 aa, Homo sapiens
QYTDSTFRVPVER

SEQ ID NO: 1871 - protein, 12 aa, Homo sapiens
SGLSTGWTQLSK

SEQ ID NO: 1872 - protein, 23 aa, Homo sapiens
KAEEEHLGILGPQLHADVGDKVK

SEQ ID NO: 1873 - protein, 13 aa, Homo sapiens
RQSEDSTFYLGER

SEQ ID NO: 1874 - protein, 18 aa, Homo sapiens
LIRDVWGIEGPIDAAFTR

SEQ ID NO: 1875 - protein, 15 aa, Homo sapiens
SKVPPPRDFHINLFR

SEQ ID NO: 1876 - protein, 10 aa, Homo sapiens
TGDKVYVHLK

SEQ ID NO: 1877 - protein, 14 aa, Homo sapiens
SLEDLQLTHNKITK

SEQ ID NO: 1878 - protein, 20 aa, Homo sapiens
SLPAPWLSMAPVSWITPGLK

SEQ ID NO: 1879 - protein, 17 aa, Homo sapiens
SVDTEHSNIYLQNGPDR

SEQ ID NO: 1880 - protein, 15 aa, Homo sapiens
GATLALTQVTPQDER

SEQ ID NO: 1881 - protein, 15 aa, Homo sapiens
RTASTPTPDDKLFQK

SEQ ID NO: 1882 - protein, 23 aa, Homo sapiens
LKHELTDEELQSLFTNFANVVDK

SEQ ID NO: 1883 - protein, 25 aa, Homo sapiens
NIPTVNENLENYYLEVNQLEKFDIK

SEQ ID NO: 1884 - protein, 12 aa, Homo sapiens
MLIHPTDSESFE

SEQ ID NO: 1885 - protein, 9 aa, Homo sapiens
WSGAVLAGR

SEQ ID NO: 1886 - protein, 13 aa, Homo sapiens
VTFELTYEELLKR

SEQ ID NO: 1887 - protein, 31 aa, Homo sapiens
KDPKEYANQFMWEYSTNYGQAPLSLLVSYTK

SEQ ID NO: 1888 - protein, 12 aa, Homo sapiens
EVTVPVFYPTEK

SEQ ID NO: 1889 - protein, 17 aa, Homo sapiens
ALLAYAFALAGNQDKRK

SEQ ID NO: 1890 - protein, 15 aa, Homo sapiens
FSISGSYVLDQILPR

SEQ ID NO: 1891 - protein, 13 aa, Homo sapiens
FPGTYQTLEMFPR

SEQ ID NO: 1892 - protein, 9 aa, Homo sapiens
DRFTEDAKR

SEQ ID NO: 1893 - protein, 15 aa, Homo sapiens
RKEFPYRIPLDLVPK

SEQ ID NO: 1894 - protein, 11 aa, Homo sapiens
AIGYLNTGYQR

SEQ ID NO: 1895 - protein, 14 aa, Homo sapiens
KGHVSFKPSLDQQR

SEQ ID NO: 1896 - protein, 20 aa, Homo sapiens
RKEFPYRIPLDLVPKTEIKR

SEQ ID NO: 1897 - protein, 14 aa, Homo sapiens
VYREYTDASFTNRK

SEQ ID NO: 1898 - protein, 15 aa, Homo sapiens
NEGTYYSPNYNPQSR

SEQ ID NO: 1899 - protein, 12 aa, Homo sapiens
EAGDHPVELLAR

SEQ ID NO: 1900 - protein, 11 aa, Homo sapiens
IAPANADFAFR

SEQ ID NO: 1901 - protein, 15 aa, Homo sapiens
LVYREYTDASFTNRK

SEQ ID NO: 1902 - protein, 14 aa, Homo sapiens
FTKETYDFDIAVLR

SEQ ID NO: 1903 - protein, 14 aa, Homo sapiens
ITGKPIKLTQVEHR

SEQ ID NO: 1904 - protein, 23 aa, Homo sapiens
EAVMDINKPGPLFKPENGLLETK

SEQ ID NO: 1905 - protein, 29 aa, Homo sapiens
FPLYNLGFGNNLNYNFLENMALENHGFAR

SEQ ID NO: 1906 - protein, 13 aa, Homo sapiens
GALDTALYAAGSK

SEQ ID NO: 1907 - protein, 17 aa, Homo sapiens
ADMVGTFTDTEDPAKFK

SEQ ID NO: 1908 - protein, 11 aa, Homo sapiens
TWTELPWPHEK

SEQ ID NO: 1909 - protein, 14 aa, Homo sapiens
KEFPYRIPLDLVPK

SEQ ID NO: 1910 - protein, 16 aa, Homo sapiens
TMLLQPAGSLGSYSYR

SEQ ID NO: 1911 - protein, 23 aa, Homo sapiens
VTTVASHTSDSDVPSGVTEVVVK

SEQ ID NO: 1912 - protein, 8 aa, Homo sapiens
GVTFLLRR

SEQ ID NO: 1913 - protein, 12 aa, Homo sapiens
VYSLNDDLKPAK

SEQ ID NO: 1914 - protein, 16 aa, Homo sapiens
GFKLPDTPQGLLGEAR

SEQ ID NO: 1915 - protein, 37 aa, Homo sapiens
LTLNFNMLEALPEGLFQHLAALESLHLQGNQLQALPR

SEQ ID NO: 1916 - protein, 12 aa, Homo sapiens
SAGTRQPQFISR

SEQ ID NO: 1917 - protein, 13 aa, Homo sapiens
LVHVEEPHTETVR

SEQ ID NO: 1918 - protein, 11 aa, Homo sapiens
VGFYESDVMGR

SEQ ID NO: 1919 - protein, 10 aa, Homo sapiens
SYQHDLALLR

SEQ ID NO: 1920 - protein, 21 aa, Homo sapiens
KYTYNYEAESSSGVPGTADSR

SEQ ID NO: 1921 - protein, 14 aa, Homo sapiens
LVDEDMNSFKADVK

SEQ ID NO: 1922 - protein, 14 aa, Homo sapiens
GDVSLKDIIDPAFR

SEQ ID NO: 1923 - protein, 18 aa, Homo sapiens
LHEAFSPVSYQHDLALLR

SEQ ID NO: 1924 - protein, 15 aa, Homo sapiens
ATISHVSPDSLYLFR

SEQ ID NO: 1925 - protein, 18 aa, Homo sapiens
IGWPNAPILIQDFETLPR

SEQ ID NO: 1926 - protein, 16 aa, Homo sapiens
KLVYREYTDASFTNRK

SEQ ID NO: 1927 - protein, 23 aa, Homo sapiens
SPSQADINKIVQILPWEQNEQVK

SEQ ID NO: 1928 - protein, 12 aa, Homo sapiens
HIQPGAFDTLDR

SEQ ID NO: 1929 - protein, 28 aa, Homo sapiens
LPSGLPVSLLTLYLDNNKISNIPDEYFK

SEQ ID NO: 1930 - protein, 16 aa, Homo sapiens
MSPPQLALNPSALLSR

SEQ ID NO: 1931 - protein, 13 aa, Homo sapiens
YREYTDASFTNRK

SEQ ID NO: 1932 - protein, 14 aa, Homo sapiens
SFEGNNNYDTPELR

SEQ ID NO: 1933 - protein, 12 aa, Homo sapiens
GLYYFTYHASSR

SEQ ID NO: 1934 - protein, 36 aa, Homo sapiens; identical to SEQ ID NO: 1097

SEQ ID NO: 1935 - protein, 14 aa, Homo sapiens
LVYREYTDASFTNR

SEQ ID NO: 1936 - protein, 15 aa, Homo sapiens
SWLAELQQWLKPGLK

SEQ ID NO: 1937 - protein, 13 aa, Homo sapiens
SQHLDNFSNQIGK

SEQ ID NO: 1938 - protein, 28 aa, Homo sapiens
NGVAQEPVHLDSPAIKHQFLLTGDTQGR

SEQ ID NO: 1939 - protein, 11 aa, Homo sapiens
TDFQDSAAAKK

SEQ ID NO: 1940 - protein, 14 aa, Homo sapiens
LVHVEEPHTETVRK

SEQ ID NO: 1941 - protein, 15 aa, Homo sapiens
FNKNNEGTYYSPNYN

SEQ ID NO: 1942 - protein, 18 aa, Homo sapiens
KSDVGFLPPFPTLDPEEK

SEQ ID NO: 1943 - protein, 24 aa, Homo sapiens
RLPGDIQVVPIGVGPNANVQELER

SEQ ID NO: 1944 - protein, 17 aa, Homo sapiens
LASPGFPGEYANDQERR

SEQ ID NO: 1945 - protein, 12 aa, Homo sapiens
PVSYQHDLALLR

SEQ ID NO: 1946 - protein, 22 aa, Homo sapiens
NKPGVYTDVAYYLAWIREHTVS

SEQ ID NO: 1947 - protein, 11 aa, Homo sapiens
IPPWEAPKEHK

SEQ ID NO: 1948 - protein, 13 aa, Homo sapiens
AVISPGFDVFAKK

SEQ ID NO: 1949 - protein, 10 aa, Homo sapiens
PPNVVEESAR

SEQ ID NO: 1950 - protein, 10 aa, Homo sapiens
STTAVVTNPK

SEQ ID NO: 1951 - protein, 9 aa, Homo sapiens
GDKVYVHLK

SEQ ID NO: 1952 - protein, 18 aa, Homo sapiens
HAIILLTDGKSNMGGSPK

SEQ ID NO: 1953 - protein, 14 aa, Homo sapiens
NFPDLNTYIYYNEK

SEQ ID NO: 1954 - protein, 30 aa, Homo sapiens
KALYLQYTDETFRTTIEKPVWLGFLGPIIK

SEQ ID NO: 1955 - protein, 16 aa, Homo sapiens
IAPQLSTEELVSLGEK

SEQ ID NO: 1956 - protein, 20 aa, Homo sapiens
FWKDNLQHKDSSVPNTGTAR

SEQ ID NO: 1957 - protein, 19 aa, Homo sapiens
AKVFKDVFLEMNIPYSVVR

SEQ ID NO: 1958 - protein, 14 aa, Homo sapiens
SLDEISQPAQELKR

SEQ ID NO: 1959 - protein, 8 aa, Homo sapiens
TPDFQLFK

SEQ ID NO: 1960 - protein, 10 aa, Homo sapiens
SIYKPGQTVK

SEQ ID NO: 1961 - protein, 26 aa, Homo sapiens
LQELHLSSNGLESLSPEFLRPVPQLR

SEQ ID NO: 1962 - protein, 12 aa, Homo sapiens
DEDMNSFKADVK

SEQ ID NO: 1963 - protein, 36 aa, Homo sapiens; identical to SEQ ID NO: 840

SEQ ID NO: 1964 - protein, 27 aa, Homo sapiens
YPIEHGIITNWDDMEKIWHHTFYNELR

SEQ ID NO: 1965 - protein, 11 aa, Homo sapiens
SLNDDLKPAKR

SEQ ID NO: 1966 - protein, 14 aa, Homo sapiens
QEPGENSEILPTLK

SEQ ID NO: 1967 - protein, 14 aa, Homo sapiens
AYIFIDEAHITQAL

SEQ ID NO: 1968 - protein, 29 aa, Homo sapiens
LPSGLPVSLLTLYLDNNKISNIPDEYFKR

SEQ ID NO: 1969 - protein, 14 aa, Homo sapiens
VAQEPVHLDSPAIK

SEQ ID NO: 1970 - protein, 11 aa, Homo sapiens
ETGDKVYVHLK

SEQ ID NO: 1971 - protein, 9 aa, Homo sapiens
IVQLIQDTR

SEQ ID NO: 1972 - protein, 30 aa, Homo sapiens
YSQPEDSLIPFFEITVPESQLTVSQFTLPK

SEQ ID NO: 1973 - protein, 24 aa, Homo sapiens
EKFSDASYQSINIPVTQNMVPSSR

SEQ ID NO: 1974 - protein, 8 aa, Homo sapiens
ITQDAQLK

SEQ ID NO: 1975 - protein, 13 aa, Homo sapiens
LWAYLTIEQLLEK

SEQ ID NO: 1976 - protein, 16 aa, Homo sapiens
ASSIIDELFQDRFFTR

SEQ ID NO: 1977 - protein, 14 aa, Homo sapiens
TLYALSHAVNNYHK

SEQ ID NO: 1978 - protein, 24 aa, Homo sapiens
VVSMDENFHPLNELIPLVYIQDPK

SEQ ID NO: 1979 - protein, 10 aa, Homo sapiens
TGYYFDGISR

SEQ ID NO: 1980 - protein, 19 aa, Homo sapiens
AFPALTSLDLSDNPGLGER

SEQ ID NO: 1981 - protein, 10 aa, Homo sapiens
SLEDLQLTHN

SEQ ID NO: 1982 - protein, 9 aa, Homo sapiens
VLSYVDWIK

SEQ ID NO: 1983 - protein, 13 aa, Homo sapiens
FLDSNIKFSHVEK

SEQ ID NO: 1984 - protein, 17 aa, Homo sapiens
TQSGLQSYLLQFHGLVR

SEQ ID NO: 1985 - protein, 14 aa, Homo sapiens
SPELEETLTHTITK

SEQ ID NO: 1986 - protein, 12 aa, Homo sapiens
YSLNDDLKPAKR

SEQ ID NO: 1987 - protein, 16 aa, Homo sapiens
HRLEDMEQALSPSVFK

SEQ ID NO: 1988 - protein, 18 aa, Homo sapiens
VAPEEHPVLLTEAPLNPK

SEQ ID NO: 1989 - protein, 19 aa, Homo sapiens
NWRDPDQTDGLGLSYLSSH

SEQ ID NO: 1990 - protein, 20 aa, Homo sapiens
EVELIVQEKPFTVEISPGPR

SEQ ID NO: 1991 - protein, 24 aa, Homo sapiens
LELELRPTGEIEQYSVSATYELQR

SEQ ID NO: 1992 - protein, 12 aa, Homo sapiens
VSDPKFHPLHSK

SEQ ID NO: 1993 - protein, 15 aa, Homo sapiens
SLTLGIEPVSPTSLR

SEQ ID NO: 1994 - protein, 12 aa, Homo sapiens
LNRVNDAQEYRR

SEQ ID NO: 1995 - protein, 32 aa, Homo sapiens
DTDRFSSHVGGTLGQFYQEVLWGSPAASDDGR

SEQ ID NO: 1996 - protein, 12 aa, Homo sapiens
VGLSDAFVVVHR

SEQ ID NO: 1997 - protein, 10 aa, Homo sapiens
NLPATDPLQR

SEQ ID NO: 1998 - protein, 8 aa, Homo sapiens
YGAATFTR

SEQ ID NO: 1999 - protein, 18 aa, Homo sapiens
VTVFPIGIGDRYDAAQLR

SEQ ID NO: 2000 - protein, 10 aa, Homo sapiens
LDFSSQADLR

SEQ ID NO: 2001 - protein, 9 aa, Homo sapiens
LTLDIQNKK

SEQ ID NO: 2002 - protein, 9 aa, Homo sapiens
GKFSVVYAK

SEQ ID NO: 2003 - protein, 18 aa, Homo sapiens
IHSGSFQSQVELSNDQEK

SEQ ID NO: 2004 - protein, 11 aa, Homo sapiens
SKEFMEEVIQR

SEQ ID NO: 2005 - protein, 8 aa, Homo sapiens
FNALQYLR

SEQ ID NO: 2006 - protein, 15 aa, Homo sapiens
TSSFALNLPTLPEVK

SEQ ID NO: 2007 - protein, 16 aa, Homo sapiens
LRNLHDLDVSDNQLER

SEQ ID NO: 2008 - protein, 10 aa, Homo sapiens
KEEFHEQSFR

SEQ ID NO: 2009 - protein, 7 aa, Homo sapiens
VFQFLEK

SEQ ID NO: 2010 - protein, 17 aa, Homo sapiens
IEDLPTMVTLGNSFLHK

SEQ ID NO: 2011 - protein, 27 aa, Homo sapiens
LELELRPTGEIEQYSVSATYELQREDR

SEQ ID NO: 2012 - protein, 23 aa, Homo sapiens
LKNIPTVNENLENYYLEVNQLEK

SEQ ID NO: 2013 - protein, 23 aa, Homo sapiens
SVSGKPQYMVLVPSLLHTETTEK

SEQ ID NO: 2014 - protein, 28 aa, Homo sapiens
FSSHVGGTLGQFYQEVLWGSPAASDDGR

SEQ ID NO: 2015 - protein, 10 aa, Homo sapiens
AIFYMNNPSR

SEQ ID NO: 2016 - protein, 15 aa, Homo sapiens
TVGSDTFYSFKYEIK

SEQ ID NO: 2017 - protein, 28 aa, Homo sapiens
VLVDHFGYTKDDKHEQDMVNGIMLSVEK

SEQ ID NO: 2018 - protein, 10 aa, Homo sapiens
KMGLAFESTK

SEQ ID NO: 2019 - protein, 22 aa, Homo sapiens
IADFELPTIIVPEQTIEIPSIK

SEQ ID NO: 2020 - protein, 12 aa, Homo sapiens
INNQLTLDSNTK

SEQ ID NO: 2021 - protein, 9 aa, Homo sapiens
FPEVDVLTK

SEQ ID NO: 2022 - protein, 28 aa, Homo sapiens
LLLLDLSHNSLLALEPGILDTANVEALR

SEQ ID NO: 2023 - protein, 12 aa, Homo sapiens
DWHGVPGQVDAA

SEQ ID NO: 2024 - protein, 10 aa, Homo sapiens
FKEEDPIHLR

SEQ ID NO: 2025 - protein, 18 aa, Homo sapiens
VPLLLSEPINIIDALEMR

SEQ ID NO: 2026 - protein, 8 aa, Homo sapiens
QIYKDLLR

SEQ ID NO: 2027 - protein, 15 aa, Homo sapiens
AISGLTIDGHAVGAK

SEQ ID NO: 2028 - protein, 32 aa, Homo sapiens
VRESDEETQIKVNWEEEAASGLLTSLKDNVPK

SEQ ID NO: 2029 - protein, 18 aa, Homo sapiens
YGMVAQVTQTLKLEDTPK

SEQ ID NO: 2030 - protein, 12 aa, Homo sapiens
VNSQSLSPYLFR

SEQ ID NO: 2031 - protein, 25 aa, Homo sapiens
LLPAQLPAEKEVGPPLPQEAVPLQK

SEQ ID NO: 2032 - protein, 21 aa, Homo sapiens
EEEHLGILGPVIWAEVGDTIR

SEQ ID NO: 2033 - protein, 15 aa, Homo sapiens
LSVAVLREDFQIQPR

SEQ ID NO: 2034 - protein, 8 aa, Homo sapiens
WPEPVFGR

SEQ ID NO: 2035 - protein, 12 aa, Homo sapiens
SKPTVSSSMEFK

SEQ ID NO: 2036 - protein, 18 aa, Homo sapiens
SLTEEAENWGDGEPNNKK

SEQ ID NO: 2037 - protein, 16 aa, Homo sapiens
EPQDTYHYLPFSLPHR

SEQ ID NO: 2038 - protein, 19 aa, Homo sapiens
QVFLYPEKDEPTYILNIKR

SEQ ID NO: 2039 - protein, 16 aa, Homo sapiens
EGGPSQIGDALGFAVR

SEQ ID NO: 2040 - protein, 10 aa, Homo sapiens
KITFEDSEIR

SEQ ID NO: 2041 - protein, 24 aa, Homo sapiens
GAYQNNEIKHIYAISSAALSASYK

SEQ ID NO: 2042 - protein, 13 aa, Homo sapiens
AASGTTGTYQEWK

SEQ ID NO: 2043 - protein, 16 aa, Homo sapiens
TEIHQGFQHLHQLFAK

SEQ ID NO: 2044 - protein, 8 aa, Homo sapiens
GEYFWEKR

SEQ ID NO: 2045 - protein, 14 aa, Homo sapiens
WTYHYSEKPMNWQR

SEQ ID NO: 2046 - protein, 17 aa, Homo sapiens
SRATLYALSHAVNNYHK

SEQ ID NO: 2047 - protein, 14 aa, Homo sapiens
NKYGMVAQVTQTLK

SEQ ID NO: 2048 - protein, 19 aa, Homo sapiens
ASGSLPYTQTLQDHLNSLK

SEQ ID NO: 2049 - protein, 14 aa, Homo sapiens
TSVLLSWEVPDSYK

SEQ ID NO: 2050 - protein, 8 aa, Homo sapiens
QIDDIDVR

SEQ ID NO: 2051 - protein, 7 aa, Homo sapiens
PVTQYLK

SEQ ID NO: 2052 - protein, 13 aa, Homo sapiens
AEPLAFTFSHDYK

SEQ ID NO: 2053 - protein, 9 aa, Homo sapiens
RFNALQYLR

SEQ ID NO: 2054 - protein, 14 aa, Homo sapiens
MQKEITALAPSTMK

SEQ ID NO: 2055 - protein, 14 aa, Homo sapiens
TLQGIPQMIGEVIR

SEQ ID NO: 2056 - protein, 7 aa, Homo sapiens
HLKPLAK

SEQ ID NO: 2057 - protein, 15 aa, Homo sapiens
VSALLTPAEQTGTWK

SEQ ID NO: 2058 - protein, 19 aa, Homo sapiens
MSAQTHGLLGQFFQPFDFK

SEQ ID NO: 2059 - protein, 10 aa, Homo sapiens
EVYGFNPEGK

SEQ ID NO: 2060 - protein, 11 aa, Homo sapiens
TEVIPPLIENR

SEQ ID NO: 2061 - protein, 9 aa, Homo sapiens
YTLFQIFSK

SEQ ID NO: 2062 - protein, 16 aa, Homo sapiens
NQGILEFYGDDIALLK

SEQ ID NO: 2063 - protein, 22 aa, Homo sapiens
NTEQEEGGEAVHEVEVVIKHNR

SEQ ID NO: 2064 - protein, 12 aa, Homo sapiens
IADFSDPAFISK

SEQ ID NO: 2065 - protein, 15 aa, Homo sapiens
EGVYTVFAPTNEAFR

SEQ ID NO: 2066 - protein, 10 aa, Homo sapiens
LTISEQNIQR

SEQ ID NO: 2067 - protein, 9 aa, Homo sapiens
GYLNTGYQR

SEQ ID NO: 2068 - protein, 16 aa, Homo sapiens
SYELPDGQVITIGNER

SEQ ID NO: 2069 - protein, 20 aa, Homo sapiens
TQFNNNEYSQDLDAYNTKDK

SEQ ID NO: 2070 - protein, 7 aa, Homo sapiens
LFGPDLK

SEQ ID NO: 2071 - protein, 11 aa, Homo sapiens
SPYQLVLQHSR

SEQ ID NO: 2072 - protein, 8 aa, Homo sapiens
SDIAPVAR

SEQ ID NO: 2073 - protein, 10 aa, Homo sapiens
NFFNPPIISR

SEQ ID NO: 2074 - protein, 20 aa, Homo sapiens
LKTQFNNNEYSQDLDAYNTK

SEQ ID NO: 2075 - protein, 36 aa, Homo sapiens; identical to SEQ ID NO: 1059

SEQ ID NO: 2076 - protein, 24 aa, Homo sapiens
FNHLGHIFTFTPQNNEFQLQLSPK

SEQ ID NO: 2077 - protein, 21 aa, Homo sapiens
AALGKLPQQANDYLNSFNWER

SEQ ID NO: 2078 - protein, 16 aa, Homo sapiens
WKYEKPDGSPVFIAFR

SEQ ID NO: 2079 - protein, 15 aa, Homo sapiens
ADVQAHGEGQEFSIT

SEQ ID NO: 2080 - protein, 28 aa, Homo sapiens
AIISNKDILATNGVIHYIDELLIPDSAK

SEQ ID NO: 2081 - protein, 22 aa, Homo sapiens
GESKLEVLNFDFQANAQLSNPK

SEQ ID NO: 2082 - protein, 13 aa, Homo sapiens
IKPVFIEDANFGR

SEQ ID NO: 2083 - protein, 11 aa, Homo sapiens
INPLALKESVK

SEQ ID NO: 2084 - protein, 7 aa, Homo sapiens
AAQLAIR

SEQ ID NO: 2085 - protein, 10 aa, Homo sapiens
TDRFLVNLVK

SEQ ID NO: 2086 - protein, 15 aa, Homo sapiens
MREIEEVLTPEMLMR

SEQ ID NO: 2087 - protein, 7 aa, Homo sapiens
FTFEYSR

SEQ ID NO: 2088 - protein, 14 aa, Homo sapiens
HFEIEVDIFEPQGI

SEQ ID NO: 2089 - protein, 12 aa, Homo sapiens
AAVSNFGYDLYR

SEQ ID NO: 2090 - protein, 12 aa, Homo sapiens
VSFELFADKVPK

SEQ ID NO: 2091 - protein, 12 aa, Homo sapiens
EANLQAAQDFVR

SEQ ID NO: 2092 - protein, 16 aa, Homo sapiens
EKDNERVFSLQWGEVK

SEQ ID NO: 2093 - protein, 14 aa, Homo sapiens
EGQMESVEAAMSSK

SEQ ID NO: 2094 - protein, 12 aa, Homo sapiens
ANLFNKLVTELR

SEQ ID NO: 2095 - protein, 7 aa, Homo sapiens
GVTFLLR

SEQ ID NO: 2096 - protein, 13 aa, Homo sapiens
SGLTIDGHAVGAK

SEQ ID NO: 2097 - protein, 13 aa, Homo sapiens
TKNSEEFAAAMSR

SEQ ID NO: 2098 - protein, 9 aa, Homo sapiens
LKFIIPSPK

SEQ ID NO: 2099 - protein, 13 aa, Homo sapiens
STSPPKQAEAVLK

SEQ ID NO: 2100 - protein, 9 aa, Homo sapiens
SVFVDWIHK

SEQ ID NO: 2101 - protein, 7 aa, Homo sapiens
GPTQEFK

SEQ ID NO: 2102 - protein, 20 aa, Homo sapiens
GAAANLELIFVGPQHAGNYR

SEQ ID NO: 2103 - protein, 16 aa, Homo sapiens
LVGGPMDASVEEEGVR

SEQ ID NO: 2104 - protein, 14 aa, Homo sapiens
IVFPHGITLDLVSR

SEQ ID NO: 2105 - protein, 19 aa, Homo sapiens
VSNQTLSLFFTVLQDVPVR

SEQ ID NO: 2106 - protein, 21 aa, Homo sapiens
NQDVHSINLPFFETLQEYFER

SEQ ID NO: 2107 - protein, 18 aa, Homo sapiens
TQFNNNEYSQDLDAYNTK

SEQ ID NO: 2108 - protein, 21 aa, Homo sapiens
SGKPQYMVLVPSLLHTETTEK

SEQ ID NO: 2109 - protein, 17 aa, Homo sapiens
VLLESIGSHEELTQDSR

SEQ ID NO: 2110 - protein, 15 aa, Homo sapiens
VEGLTFQQNSLNWMK

SEQ ID NO: 2111 - protein, 23 aa, Homo sapiens
WVQTLSEQVQEELLSSQVTQELR

SEQ ID NO: 2112 - protein, 15 aa, Homo sapiens
NVVFVIDKSGSMSGR

SEQ ID NO: 2113 - protein, 13 aa, Homo sapiens
VNKDDEEFIESNK

SEQ ID NO: 2114 - protein, 15 aa, Homo sapiens
QEYLSILTDPDGKGK

SEQ ID NO: 2115 - protein, 12 aa, Homo sapiens
DMYSFLEDMGLK

SEQ ID NO: 2116 - protein, 13 aa, Homo sapiens
GTFTDTEDPAKFK

SEQ ID NO: 2117 - protein, 19 aa, Homo sapiens
RLTVGAAQVPAQLLVGALR

SEQ ID NO: 2118 - protein, 18 aa, Homo sapiens
ILGDPEALRDLLNNHILK

SEQ ID NO: 2119 - protein, 22 aa, Homo sapiens
ATGVLYDYVNKYHWEHTGLTLR

SEQ ID NO: 2120 - protein, 11 aa, Homo sapiens
KTDRFLVNLVK

SEQ ID NO: 2121 - protein, 22 aa, Homo sapiens
SLNEEAVKKDNSVHWERPQKPK

SEQ ID NO: 2122 - protein, 13 aa, Homo sapiens
LLDLVFLLDGSSR

SEQ ID NO: 2123 - protein, 13 aa, Homo sapiens
GSDTFYSFKYEIK

SEQ ID NO: 2124 - protein, 8 aa, Homo sapiens
AVLHIGEK

SEQ ID NO: 2125 - protein, 12 aa, Homo sapiens
PLVYIQDPKGNR

SEQ ID NO: 2126 - protein, 21 aa, Homo sapiens
LSLESLTSYFSIESSTKGDVK

SEQ ID NO: 2127 - protein, 6 aa, Homo sapiens
VIGTLK

SEQ ID NO: 2128 - protein, 13 aa, Homo sapiens
VYSLNDDLKPAKR

SEQ ID NO: 2129 - protein, 16 aa, Homo sapiens
LASPGFPGEYANDQER

SEQ ID NO: 2130 - protein, 11 aa, Homo sapiens
NSEEFAAAMSR

SEQ ID NO: 2131 - protein, 17 aa, Homo sapiens
SVSDGIAALDLNAVANK

SEQ ID NO: 2132 - protein, 7 aa, Homo sapiens
PQVSPVR

SEQ ID NO: 2133 - protein, 15 aa, Homo sapiens
LLSGGNTLHLVSTTK

SEQ ID NO: 2134 - protein, 14 aa, Homo sapiens
AEFTGRHDAHLNGK

SEQ ID NO: 2135 - protein, 9 aa, Homo sapiens
YLDFVFAVK

SEQ ID NO: 2136 - protein, 11 aa, Homo sapiens
AQWANPFDPSK

SEQ ID NO: 2137 - protein, 8 aa, Homo sapiens
TGLKEFLK

SEQ ID NO: 2138 - protein, 11 aa, Homo sapiens
SEYQADYESLR

SEQ ID NO: 2139 - protein, 12 aa, Homo sapiens
ELKEQQDSPGNK

SEQ ID NO: 2140 - protein, 6 aa, Homo sapiens
FLNDVK

SEQ ID NO: 2141 - protein, 16 aa, Homo sapiens
QYPQDAVLALTQNHHK

SEQ ID NO: 2142 - protein, 18 aa, Homo sapiens
LLLQQVSLPELPGEYSMK

SEQ ID NO: 2143 - protein, 9 aa, Homo sapiens
VEDFGNAWK

SEQ ID NO: 2144 - protein, 11 aa, Homo sapiens
SSGSLLNNAIK

SEQ ID NO: 2145 - protein, 15 aa, Homo sapiens
GEVQAMLGQSTEELR

SEQ ID NO: 2146 - protein, 20 aa, Homo sapiens
FFTREPQDTYHYLPFSLPHR

SEQ ID NO: 2147 - protein, 10 aa, Homo sapiens
RQDGSVDFFR

SEQ ID NO: 2148 - protein, 17 aa, Homo sapiens
GEVQAMLGQSTEELRVR

SEQ ID NO: 2149 - protein, 6 aa, Homo sapiens
FLNWIK

SEQ ID NO: 2150 - protein, 12 aa, Homo sapiens
VHVEEPHTETVR

SEQ ID NO: 2151 - protein, 12 aa, Homo sapiens
GEVDHYQLALGK

SEQ ID NO: 2152 - protein, 18 aa, Homo sapiens
FFHKNEIWYRTEQAAVAR

SEQ ID NO: 2153 - protein, 10 aa, Homo sapiens
DGLKYHYLIR

SEQ ID NO: 2154 - protein, 10 aa, Homo sapiens
ELLALIQLER

SEQ ID NO: 2155 - protein, 9 aa, Homo sapiens
QTEATMTFK

SEQ ID NO: 2156 - protein, 11 aa, Homo sapiens
KLSFYYLIMAK

SEQ ID NO: 2157 - protein, 13 aa, Homo sapiens
ALVEQGFTVPEIK

SEQ ID NO: 2158 - protein, 12 aa, Homo sapiens
IPSVQINFKDLK

SEQ ID NO: 2159 - protein, 11 aa, Homo sapiens
HFQNLGKDGLK

SEQ ID NO: 2160 - protein, 11 aa, Homo sapiens
SSNHVLIYLDK

SEQ ID NO: 2161 - protein, 28 aa, Homo sapiens
SVSLPSLDPASAKIEGNLIFDPNNYLPK

SEQ ID NO: 2162 - protein, 9 aa, Homo sapiens
GMALFGEGK

SEQ ID NO: 2163 - protein, 21 aa, Homo sapiens
ITGTMPPLPLEATGLALSSLR

SEQ ID NO: 2164 - protein, 8 aa, Homo sapiens
SYYWIGIR

SEQ ID NO: 2165 - protein, 19 aa, Homo sapiens
VDLSFSPSQSLPASHAHLR

SEQ ID NO: 2166 - protein, 13 aa, Homo sapiens
AKSPYQLVLQHSR

SEQ ID NO: 2167 - protein, 9 aa, Homo sapiens
VVGGLVALR

SEQ ID NO: 2168 - protein, 7 aa, Homo sapiens
TLQELKK

SEQ ID NO: 2169 - protein, 15 aa, Homo sapiens
IGQDGISTSATTNLK

SEQ ID NO: 2170 - protein, 11 aa, Homo sapiens
LDFREIQIYKK

SEQ ID NO: 2171 - protein, 16 aa, Homo sapiens
TRDRLDEVKEQVAEVR

SEQ ID NO: 2172 - protein, 13 aa, Homo sapiens
IAELSATAQEIIK

SEQ ID NO: 2173 - protein, 13 aa, Homo sapiens
LVPSLLHTETTEK

SEQ ID NO: 2174 - protein, 40 aa, Homo sapiens
ASGSLPYTQTLQDHLNSLKEFNLQNMGLPDFHIPENLFLK

SEQ ID NO: 2175 - protein, 17 aa, Homo sapiens
NMAEQIIQEIYSQIQSK

SEQ ID NO: 2176 - protein, 13 aa, Homo sapiens
PSQSLPASHAHLR

SEQ ID NO: 2177 - protein, 7 aa, Homo sapiens
RKEYEMK

SEQ ID NO: 2178 - protein, 13 aa, Homo sapiens
LAYAFALAGNQDK

SEQ ID NO: 2179 - protein, 17 aa, Homo sapiens
AQGFTEDTIVFLPQTDK

SEQ ID NO: 2180 - protein, 15 aa, Homo sapiens
TAVDHIREILNINQK

SEQ ID NO: 2181 - protein, 12 aa, Homo sapiens
DFLGFYVVDSHR

SEQ ID NO: 2182 - protein, 10 aa, Homo sapiens
EVSFDVELPK

SEQ ID NO: 2183 - protein, 11 aa, Homo sapiens
GLQVALEEFHK

SEQ ID NO: 2184 - protein, 18 aa, Homo sapiens
SGGRTEHPFTVEEFVLPK

SEQ ID NO: 2185 - protein, 11 aa, Homo sapiens
ALWEKPFISSR

SEQ ID NO: 2186 - protein, 19 aa, Homo sapiens
AVNRADTAKEVSFDVELPK

SEQ ID NO: 2187 - protein, 31 aa, Homo sapiens; identical to SEQ ID NO: 890

SEQ ID NO: 2188 - protein, 14 aa, Homo sapiens
TALDDRKEGAVLAK

SEQ ID NO: 2189 - protein, 12 aa, Homo sapiens
VPSLLHTETTEK

SEQ ID NO: 2190 - protein, 13 aa, Homo sapiens
VLAKPQNTAEVQK

SEQ ID NO: 2191 - protein, 14 aa, Homo sapiens
QGETLNFLEIGYSR

SEQ ID NO: 2192 - protein, 11 aa, Homo sapiens
SASNMAIVDVK

SEQ ID NO: 2193 - protein, 20 aa, Homo sapiens
SVGFHLPSREFQVPTFTIPK

SEQ ID NO: 2194 - protein, 13 aa, Homo sapiens
NQGNTWLTAFVLK

SEQ ID NO: 2195 - protein, 15 aa, Homo sapiens
KMTSNFPVDLSDYPK

SEQ ID NO: 2196 - protein, 21 aa, Homo sapiens
GHGATNDLTFTEEVDMKEMEK

SEQ ID NO: 2197 - protein, 7 aa, Homo sapiens
ITLPDFR

SEQ ID NO: 2198 - protein, 10 aa, Homo sapiens
DKIGVELTGR

SEQ ID NO: 2199 - protein, 11 aa, Homo sapiens
SEILAHWSPAK

SEQ ID NO: 2200 - protein, 9 aa, Homo sapiens
AFVVDMMER

SEQ ID NO: 2201 - protein, 9 aa, Homo sapiens
HINIDQFVR

SEQ ID NO: 2202 - protein, 18 aa, Homo sapiens
EGAIHREELVYELNPLDH

SEQ ID NO: 2203 - protein, 11 aa, Homo sapiens
LYLQYTDETFR

SEQ ID NO: 2204 - protein, 14 aa, Homo sapiens
NSLKIEIPLPFGGK

SEQ ID NO: 2205 - protein, 17 aa, Homo sapiens
AFQPFFVELTMPYSVIR

SEQ ID NO: 2206 - protein, 16 aa, Homo sapiens
VMFTEDLKLPASFDAR

SEQ ID NO: 2207 - protein, 15 aa, Homo sapiens
NTASLKYENYELTLK

SEQ ID NO: 2208 - protein, 21 aa, Homo sapiens
GGTLSTPQTGSENDALYEYLR

SEQ ID NO: 2209 - protein, 27 aa, Homo sapiens
AVDQSVLLMKPDAELSASSVYNLLPEK

SEQ ID NO: 2210 - protein, 12 aa, Homo sapiens
VVYRQYTDSTFR

SEQ ID NO: 2211 - protein, 6 aa, Homo sapiens
ANLFNK

SEQ ID NO: 2212 - protein, 9 aa, Homo sapiens
LAVYQAGAR

SEQ ID NO: 2213 - protein, 9 aa, Homo sapiens
LDVTTSIGR

SEQ ID NO: 2214 - protein, 8 aa, Homo sapiens
TFTLLDPK

SEQ ID NO: 2215 - protein, 21 aa, Homo sapiens
AVVFLEPQWYSVLEKDSVTLK

SEQ ID NO: 2216 - protein, 13 aa, Homo sapiens
QAEISASAPTSLR

SEQ ID NO: 2217 - protein, 7 aa, Homo sapiens
FTDLHLR

SEQ ID NO: 2218 - protein, 8 aa, Homo sapiens
DMVEYKDR

SEQ ID NO: 2219 - protein, 10 aa, Homo sapiens
RPYLKVFNPR

SEQ ID NO: 2220 - protein, 12 aa, Homo sapiens
LPTGDVIGDSAK

SEQ ID NO: 2221 - protein, 11 aa, Homo sapiens
LNRVNDAQEYR

SEQ ID NO: 2222 - protein, 16 aa, Homo sapiens
QFSFPLSSEPFQGSYK

SEQ ID NO: 2223 - protein, 16 aa, Homo sapiens
VDSHFRQGIPFFGQVR

SEQ ID NO: 2224 - protein, 17 aa, Homo sapiens
VQAAVGTSAAPVPSDNH

SEQ ID NO: 2225 - protein, 7 aa, Homo sapiens
FLVNLVK

SEQ ID NO: 2226 - protein, 31 aa, Homo sapiens; identical to SEQ ID NO: 964

SEQ ID NO: 2227 - protein, 13 aa, Homo sapiens
FVTAVGTQGAISK

SEQ ID NO: 2228 - protein, 10 aa, Homo sapiens
NALALFVLPK

SEQ ID NO: 2229 - protein, 10 aa, Homo sapiens
QQTEWQSGQR

SEQ ID NO: 2230 - protein, 10 aa, Homo sapiens
IKFDKYKAEK

SEQ ID NO: 2231 - protein, 17 aa, Homo sapiens
FLLKAEPLAFTFSHDYK

SEQ ID NO: 2232 - protein, 16 aa, Homo sapiens
SGIPIVTSPYQIHFTK

SEQ ID NO: 2233 - protein, 7 aa, Homo sapiens
FLDSNIK

SEQ ID NO: 2234 - protein, 12 aa, Homo sapiens
NPNGYSFSIPVK

SEQ ID NO: 2235 - protein, 10 aa, Homo sapiens
PAFLAVPVEK

SEQ ID NO: 2236 - protein, 8 aa, Homo sapiens
DLKPAIVK

SEQ ID NO: 2237 - protein, 9 aa, Homo sapiens
TFAHYATFR

SEQ ID NO: 2238 - protein, 10 aa, Homo sapiens
LAPGELTIIL

SEQ ID NO: 2239 - protein, 15 aa, Homo sapiens
TITKLSFVKVDSHFR

SEQ ID NO: 2240 - protein, 9 aa, Homo sapiens
LLSALVETR

SEQ ID NO: 2241 - protein, 7 aa, Homo sapiens
PHTETVR

SEQ ID NO: 2242 - protein, 17 aa, Homo sapiens
LDDYVNTQGASLFSVTK

SEQ ID NO: 2243 - protein, 23 aa, Homo sapiens
QQNAQGGFSSTQDTVVALHALSK

SEQ ID NO: 2244 - protein, 15 aa, Homo sapiens
ALQERDYIFGNYIER

SEQ ID NO: 2245 - protein, 11 aa, Homo sapiens
FWEPMKVHDIR

SEQ ID NO: 2246 - protein, 20 aa, Homo sapiens
AYIFIDEAHITQALIWLSQR

SEQ ID NO: 2247 - protein, 17 aa, Homo sapiens
WNFEKFLVGPDGIPIMR

SEQ ID NO: 2248 - protein, 11 aa, Homo sapiens
ALMDETMKELK

SEQ ID NO: 2249 - protein, 8 aa, Homo sapiens
ELNELGSK

SEQ ID NO: 2250 - protein, 10 aa, Homo sapiens
LSEAEFEVLK

SEQ ID NO: 2251 - protein, 10 aa, Homo sapiens
IDDIWNLEVK

SEQ ID NO: 2252 - protein, 14 aa, Homo sapiens
GATTSPGVYELSSR

SEQ ID NO: 2253 - protein, 10 aa, Homo sapiens
RLAVYQAGAR

SEQ ID NO: 2254 - protein, 15 aa, Homo sapiens
VRVYSLNDDLKPAKR

SEQ ID NO: 2255 - protein, 34 aa, Homo sapiens
EQLSLLDRFTEDAKRLYGSEAFATDFQDSAAAKK

SEQ ID NO: 2256 - protein, 8 aa, Homo sapiens
TGHVIAVK

SEQ ID NO: 2257 - protein, 14 aa, Homo sapiens
AHLDIAGSLEGHLR

SEQ ID NO: 2258 - protein, 17 aa, Homo sapiens
EQVGGPSLTSDLQAQSK

SEQ ID NO: 2259 - protein, 25 aa, Homo sapiens
IDFLNNYALFLSPSAQQASWQVSAR

SEQ ID NO: 2260 - protein, 21 aa, Homo sapiens
GPKPALPAGTEDTAKEDAANR

SEQ ID NO: 2261 - protein, 10 aa, Homo sapiens
DGKFSVVYAK

SEQ ID NO: 2262 - protein, 12 aa, Homo sapiens
NQEQVSPLTLLK

SEQ ID NO: 2263 - protein, 17 aa, Homo sapiens
QLNYKHYDGSYSTFGER

SEQ ID NO: 2264 - protein, 18 aa, Homo sapiens
RAPYPNYDRDILTIDIGR

SEQ ID NO: 2265 - protein, 15 aa, Homo sapiens
LAARLEALKENGGAR

SEQ ID NO: 2266 - protein, 21 aa, Homo sapiens
ALLAYAFALAGNQDKRKEVLK

SEQ ID NO: 2267 - protein, 6 aa, Homo sapiens
TTVMVK

SEQ ID NO: 2268 - protein, 17 aa, Homo sapiens
VKDLATVYVDVLKDSGR

SEQ ID NO: 2269 - protein, 7 aa, Homo sapiens
LFWEPMK

SEQ ID NO: 2270 - protein, 11 aa, Homo sapiens
LPPNVVEESAR

SEQ ID NO: 2271 - protein, 14 aa, Homo sapiens
TGTHGLLVKQEDMK

SEQ ID NO: 2272 - protein, 15 aa, Homo sapiens
ENKEVVLQWFTENSK

SEQ ID NO: 2273 - protein, 16 aa, Homo sapiens
LDVPVWDVEATLNFLK

SEQ ID NO: 2274 - protein, 23 aa, Homo sapiens
QEDMKGHFSISIPVKSDIAPVAR

SEQ ID NO: 2275 - protein, 15 aa, Homo sapiens
GLASANVDFAFSLYK

SEQ ID NO: 2276 - protein, 10 aa, Homo sapiens
DFDFVPPVVR

SEQ ID NO: 2277 - protein, 27 aa, Homo sapiens
GVGGSQPPDIDKTELVEPTEYLVVHLK

SEQ ID NO: 2278 - protein, 15 aa, Homo sapiens
SLEVTFTPVIEDIGK

SEQ ID NO: 2279 - protein, 26 aa, Homo sapiens
LLSGGNTLHLVSTTKTEVIPPLIENR

SEQ ID NO: 2280 - protein, 7 aa, Homo sapiens
FSVVYAK

SEQ ID NO: 2281 - protein, 11 aa, Homo sapiens
LDGKFSVVYAK

SEQ ID NO: 2282 - protein, 14 aa, Homo sapiens
MSSINADFAFNLYR

SEQ ID NO: 2283 - protein, 12 aa, Homo sapiens
RHPDLSIPELLR

SEQ ID NO: 2284 - protein, 14 aa, Homo sapiens
KDNSVHWERPQKPK

SEQ ID NO: 2285 - protein, 11 aa, Homo sapiens
EALQGVGDMGR

SEQ ID NO: 2286 - protein, 18 aa, Homo sapiens
DDKHEQDMVNGIMLSVEK

SEQ ID NO: 2287 - protein, 15 aa, Homo sapiens
VLHPLEGAVVIIFKK

SEQ ID NO: 2288 - protein, 19 aa, Homo sapiens
VAVVEYHDGSHAYIGLKDR

SEQ ID NO: 2289 - protein, 10 aa, Homo sapiens
TQILEWAAER

SEQ ID NO: 2290 - protein, 15 aa, Homo sapiens
KYFPETWIWDLVVVN

SEQ ID NO: 2291 - protein, 7 aa, Homo sapiens
ENLSVQK

SEQ ID NO: 2292 - protein, 13 aa, Homo sapiens
VNVDEVGGEALGR

SEQ ID NO: 2293 - protein, 9 aa, Homo sapiens
VQGVEFSHR

SEQ ID NO: 2294 - protein, 11 aa, Homo sapiens
KTLLSNLEEAK

SEQ ID NO: 2295 - protein, 10 aa, Homo sapiens
LHMLQISYFR

SEQ ID NO: 2296 - protein, 12 aa, Homo sapiens
YFHHNSDFYIPK

SEQ ID NO: 2297 - protein, 13 aa, Homo sapiens
LGEVDHYQLALGK

SEQ ID NO: 2298 - protein, 20 aa, Homo sapiens
QHVVYGPWNLPQSSYSHLTR

SEQ ID NO: 2299 - protein, 14 aa, Homo sapiens
PAPLVAPGNQVTLR

SEQ ID NO: 2300 - protein, 17 aa, Homo sapiens
KDTVIKPLLVEPEGLEK

SEQ ID NO: 2301 - protein, 7 aa, Homo sapiens
PFFGQVR

SEQ ID NO: 2302 - protein, 20 aa, Homo sapiens
NEEAVKKDNSVHWERPQKPK

SEQ ID NO: 2303 - protein, 7 aa, Homo sapiens
GEAFTLK

SEQ ID NO: 2304 - protein, 11 aa, Homo sapiens
ENFAGEATLQR

SEQ ID NO: 2305 - protein, 19 aa, Homo sapiens
VVNRANTVQEATFQMELPK

SEQ ID NO: 2306 - protein, 16 aa, Homo sapiens
DTVIKPLLVEPEGLEK

SEQ ID NO: 2307 - protein, 8 aa, Homo sapiens
PTLVEVSR

SEQ ID NO: 2308 - protein, 25 aa, Homo sapiens
IFNFEKAYFILDEFIIGGEIQETSK

SEQ ID NO: 2309 - protein, 26 aa, Homo sapiens
FRVVSMDENFHPLNELIPLVYIQDPK

SEQ ID NO: 2310 - protein, 11 aa, Homo sapiens
SNTVASLHTEK

SEQ ID NO: 2311 - protein, 10 aa, Homo sapiens
LSFYYLIMAK

SEQ ID NO: 2312 - protein, 19 aa, Homo sapiens
NIQEYLSILTDPDGKGKEK

SEQ ID NO: 2313 - protein, 10 aa, Homo sapiens
VYELNPLDHR

SEQ ID NO: 2314 - protein, 22 aa, Homo sapiens
IPVIEPSVPELVVKPGATVTLR

SEQ ID NO: 2315 - protein, 17 aa, Homo sapiens
TEAPSATGQASSLLGGR

SEQ ID NO: 2316 - protein, 7 aa, Homo sapiens
TKVFQLK

SEQ ID NO: 2317 - protein, 6 aa, Homo sapiens
NIFNFK

SEQ ID NO: 2318 - protein, 27 aa, Homo sapiens
WITKQQNAQGGFSSTQDTVVALHALSK

SEQ ID NO: 2319 - protein, 17 aa, Homo sapiens
SSFTVQDLKPFTEYVFR

SEQ ID NO: 2320 - protein, 18 aa, Homo sapiens
VFSNGADLSGVTEEAPLK

SEQ ID NO: 2321 - protein, 9 aa, Homo sapiens
LGEPIPISK

SEQ ID NO: 2322 - protein, 8 aa, Homo sapiens
KYTFELSR

SEQ ID NO: 2323 - protein, 11 aa, Homo sapiens
HIVTFDGQNFK

SEQ ID NO: 2324 - protein, 16 aa, Homo sapiens
LEIWDGFPDVGPHIGR

SEQ ID NO: 2325 - protein, 8 aa, Homo sapiens
AGNQDKRK

SEQ ID NO: 2326 - protein, 13 aa, Homo sapiens
MVSGFIPLKPTVK

SEQ ID NO: 2327 - protein, 23 aa, Homo sapiens
HQGVMVGMGQKDSYVGDEAQSKR

SEQ ID NO: 2328 - protein, 11 aa, Homo sapiens
ALFLETEQLKK

SEQ ID NO: 2329 - protein, 11 aa, Homo sapiens
PLRAELQEGAR

SEQ ID NO: 2330 - protein, 22 aa, Homo sapiens
ALALPPLGLAPLLNLWAKPQGR

SEQ ID NO: 2331 - protein, 19 aa, Homo sapiens
NQGNTWLTAFVLKTFAQAR

SEQ ID NO: 2332 - protein, 19 aa, Homo sapiens
RSSAYKWKETLFSVMPGLK

SEQ ID NO: 2333 - protein, 8 aa, Homo sapiens
LVVLPFPK

SEQ ID NO: 2334 - protein, 28 aa, Homo sapiens
TTVMVKNEDSLVFVQTDKSIYKPGQTVK

SEQ ID NO: 2335 - protein, 15 aa, Homo sapiens
VRDIEHLTSLDFFRK

SEQ ID NO: 2336 - protein, 11 aa, Homo sapiens
HVEEPHTETVR

SEQ ID NO: 2337 - protein, 11 aa, Homo sapiens
LSFVKVDSHFR

SEQ ID NO: 2338 - protein, 30 aa, Homo sapiens
GIQVEIYSFPKDPEIHLSGPLEAGKPITVK

SEQ ID NO: 2339 - protein, 13 aa, Homo sapiens
LLQKGWVDLFVPK

SEQ ID NO: 2340 - protein, 6 aa, Homo sapiens
FQNLDK

SEQ ID NO: 2341 - protein, 15 aa, Homo sapiens
FSISATYDLGATLLK

SEQ ID NO: 2342 - protein, 10 aa, Homo sapiens
VKEEVFIQQR

SEQ ID NO: 2343 - protein, 9 aa, Homo sapiens
KALQTEMAR

SEQ ID NO: 2344 - protein, 10 aa, Homo sapiens
PELPGEYSMK

SEQ ID NO: 2345 - protein, 9 aa, Homo sapiens
SNMAIVDVK

SEQ ID NO: 2346 - protein, 9 aa, Homo sapiens
QDGSVDFFR

SEQ ID NO: 2347 - protein, 17 aa, Homo sapiens
KYTPEQVAMATVTALHR

SEQ ID NO: 2348 - protein, 12 aa, Homo sapiens
VSGFIPLKPTVK

SEQ ID NO: 2349 - protein, 25 aa, Homo sapiens
TWDPEGVIFYGDTNPKDDWFMLGLR

SEQ ID NO: 2350 - protein, 22 aa, Homo sapiens
NEDSLVFVQTDKSIYKPGQTVK

SEQ ID NO: 2351 - protein, 11 aa, Homo sapiens
LKMLEVPYVDR

SEQ ID NO: 2352 - protein, 10 aa, Homo sapiens
VSVFVDWIHK

SEQ ID NO: 2353 - protein, 12 aa, Homo sapiens
MNFKQELNGNTK

SEQ ID NO: 2354 - protein, 13 aa, Homo sapiens
AQEGDHGSHVYTK

SEQ ID NO: 2355 - protein, 10 aa, Homo sapiens
QTVSWAVTPK

SEQ ID NO: 2356 - protein, 13 aa, Homo sapiens
DSGVTVNGELIGA

SEQ ID NO: 2357 - protein, 18 aa, Homo sapiens
LTVGAAQVPAQLLVGALR

SEQ ID NO: 2358 - protein, 9 aa, Homo sapiens
GWVDLFVPK

SEQ ID NO: 2359 - protein, 11 aa, Homo sapiens
KWEAEPVYVQR

SEQ ID NO: 2360 - protein, 11 aa, Homo sapiens
ETYDFDIAVLR

SEQ ID NO: 2361 - protein, 13 aa, Homo sapiens
GELEHGLITFSTR

SEQ ID NO: 2362 - protein, 19 aa, Homo sapiens
DSWLDKQAEISASAPTSLR

SEQ ID NO: 2363 - protein, 7 aa, Homo sapiens
AQITGYR

SEQ ID NO: 2364 - protein, 20 aa, Homo sapiens
IEEVFKEVQNLKEIVNSLKK

SEQ ID NO: 2365 - protein, 23 aa, Homo sapiens
TEHPFTVEEFVLPKFEVQVTVPK

SEQ ID NO: 2366 - protein, 12 aa, Homo sapiens
WVFKEEDPIHLR

SEQ ID NO: 2367 - protein, 30 aa, Homo sapiens
MGIQHAYSENADFSGLTEDNGLKLSNAAHK

SEQ ID NO: 2368 - protein, 9 aa, Homo sapiens
IPNKVIFIR

SEQ ID NO: 2369 - protein, 7 aa, Homo sapiens
KVDSHFR

SEQ ID NO: 2370 - protein, 14 aa, Homo sapiens
LAYAFALAGNQDKR

SEQ ID NO: 2371 - protein, 11 aa, Homo sapiens
LHIDDMEFEPK

SEQ ID NO: 2372 - protein, 24 aa, Homo sapiens
VVLSSGSGPGLDLPLVLGLPLQLK

SEQ ID NO: 2373 - protein, 9 aa, Homo sapiens
MVELHNLYR

SEQ ID NO: 2374 - protein, 17 aa, Homo sapiens
YTIITTPPLKDFSLWEK

SEQ ID NO: 2375 - protein, 18 aa, Homo sapiens
GHFSISIPVKSDIAPVAR

SEQ ID NO: 2376 - protein, 13 aa, Homo sapiens
AIFSVGPVSPSRR

SEQ ID NO: 2377 - protein, 46 aa, Homo sapiens; identical to SEQ ID NO: 868

SEQ ID NO: 2378 - protein, 10 aa, Homo sapiens
IVQIYKDLLR

SEQ ID NO: 2379 - protein, 13 aa, Homo sapiens
VKDLATVYVDVLK

SEQ ID NO: 2380 - protein, 22 aa, Homo sapiens
DGRPEIQLHNHWAQLTVGAGPR

SEQ ID NO: 2381 - protein, 22 aa, Homo sapiens
SSSNEEVMFLTVQVKGPTQEFK

SEQ ID NO: 2382 - protein, 17 aa, Homo sapiens
FFHPEEWADLFQAAGAK

SEQ ID NO: 2383 - protein, 28 aa, Homo sapiens
QAAGSGHLLALGTPENPSWLSLHLQDQK

SEQ ID NO: 2384 - protein, 11 aa, Homo sapiens
ILHLPTSWDWR

SEQ ID NO: 2385 - protein, 6 aa, Homo sapiens
SVVYAK

SEQ ID NO: 2386 - protein, 11 aa, Homo sapiens
QITVNDLPVGR

SEQ ID NO: 2387 - protein, 14 aa, Homo sapiens
GALISDQWVLTAAH

SEQ ID NO: 2388 - protein, 12 aa, Homo sapiens
DEIPHNDIALLK

SEQ ID NO: 2389 - protein, 6 aa, Homo sapiens
RHPIMR

SEQ ID NO: 2390 - protein, 10 aa, Homo sapiens
SFVKVDSHFR

SEQ ID NO: 2391 - protein, 17 aa, Homo sapiens
MGVVSLGSPSGEVSHPR

SEQ ID NO: 2392 - protein, 13 aa, Homo sapiens
WWGGQPLWITATK

SEQ ID NO: 2393 - protein, 19 aa, Homo sapiens
DIPQPHAEPWAFSLDLGLK

SEQ ID NO: 2394 - protein, 7 aa, Homo sapiens
SILFLGK

SEQ ID NO: 2395 - protein, 19 aa, Homo sapiens
YAVSEAAAHKYGIDWASGR

SEQ ID NO: 2396 - protein, 9 aa, Homo sapiens
SFMLLILER

SEQ ID NO: 2397 - protein, 15 aa, Homo sapiens
ALLAYAFALAGNQDK

SEQ ID NO: 2398 - protein, 7 aa, Homo sapiens
PGEYSMK

SEQ ID NO: 2399 - protein, 13 aa, Homo sapiens
SYTSHTNEIHKGK

SEQ ID NO: 2400 - protein, 12 aa, Homo sapiens
GTFQWTIEEEVR

SEQ ID NO: 2401 - protein, 12 aa, Homo sapiens
GVPIPNKVIFIR

SEQ ID NO: 2402 - protein, 14 aa, Homo sapiens
IVQILPWEQNEQVK

SEQ ID NO: 2403 - protein, 23 aa, Homo sapiens
GQPLSPEKYVTSAPMPEPQAPGR

SEQ ID NO: 2404 - protein, 11 aa, Homo sapiens
SYTSHTNEIHK

SEQ ID NO: 2405 - protein, 13 aa, Homo sapiens
ALQASALAAWGGK

SEQ ID NO: 2406 - protein, 8 aa, Homo sapiens
FLENEDRR

SEQ ID NO: 2407 - protein, 23 aa, Homo sapiens
AEPLAFTFSHDYKGSTSHHLVSR

SEQ ID NO: 2408 - protein, 15 aa, Homo sapiens
SSSNEEVMFLTVQVK

SEQ ID NO: 2409 - protein, 27 aa, Homo sapiens
SGGRTEHPFTVEEFVLPKFEVQVTVPK

SEQ ID NO: 2410 - protein, 17 aa, Homo sapiens
VGSPNAAVLWLWSSHNR

SEQ ID NO: 2411 - protein, 7 aa, Homo sapiens
WHQVEVK

SEQ ID NO: 2412 - protein, 15 aa, Homo sapiens
LAYAFALAGNQDKRK

SEQ ID NO: 2413 - protein, 10 aa, Homo sapiens
SPLGEEMRDR

SEQ ID NO: 2414 - protein, 15 aa, Homo sapiens
ELSHLPSLYDYSAYR

SEQ ID NO: 2415 - protein, 18 aa, Homo sapiens
RQRASLSSAPVVLVGDHA

SEQ ID NO: 2416 - protein, 18 aa, Homo sapiens
VSVQLEASPAFLAVPVEK

SEQ ID NO: 2417 - protein, 16 aa, Homo sapiens
ALLAYAFALAGNQDKR

SEQ ID NO: 2418 - protein, 15 aa, Homo sapiens
DGKGVPIPNKVIFIR

SEQ ID NO: 2419 - protein, 13 aa, Homo sapiens
SKEFQLFSSPHGK

SEQ ID NO: 2420 - protein, 11 aa, Homo sapiens
DLATVYVDVLK

SEQ ID NO: 2421 - protein, 13 aa, Homo sapiens
SDLAVPSELALLK

SEQ ID NO: 2422 - protein, 22 aa, Homo sapiens
QFSFPLSSEPFQGSYKVVVQKK

SEQ ID NO: 2423 - protein, 30 aa, Homo sapiens; identical to SEQ ID NO: 1034

SEQ ID NO: 2424 - protein, 9 aa, Homo sapiens
PLVYIQDPK

SEQ ID NO: 2425 - protein, 22 aa, Homo sapiens
DGREWEIVNQDNHYSPHFQEIR

SEQ ID NO: 2426 - protein, 12 aa, Homo sapiens
IGNFSTDIKDSK

SEQ ID NO: 2427 - protein, 12 aa, Homo sapiens
LDDGRWHQVEVK

SEQ ID NO: 2428 - protein, 15 aa, Homo sapiens
YLYHGQTLETLGGKK

SEQ ID NO: 2429 - protein, 13 aa, Homo sapiens
NEQEQPLGQWHLS

SEQ ID NO: 2430 - protein, 22 aa, Homo sapiens
GTEAAGAMFLEAIPMSIPPEVK

SEQ ID NO: 2431 - protein, 22 aa, Homo sapiens
SGVQMNTNFFHESGLEAHVALK

SEQ ID NO: 2432 - protein, 15 aa, Homo sapiens
ALYWVNGQVPDGVSK

SEQ ID NO: 2433 - protein, 20 aa, Homo sapiens
AHFSPSNIILDFPAAGSAAR

SEQ ID NO: 2434 - protein, 9 aa, Homo sapiens
ATVLNYLPK

SEQ ID NO: 2435 - protein, 18 aa, Homo sapiens
TGKAAQVTIQSSGTFSSK

SEQ ID NO: 2436 - protein, 16 aa, Homo sapiens
YGRNQGNTWLTAFVLK

SEQ ID NO: 2437 - protein, 14 aa, Homo sapiens
DTVGTIQLINDHVK

SEQ ID NO: 2438 - protein, 33 aa, Homo sapiens; identical to SEQ ID NO: 1039

SEQ ID NO: 2439 - protein, 11 aa, Homo sapiens
LLRDADDLQKR

SEQ ID NO: 2440 - protein, 8 aa, Homo sapiens
PNKVIFIR

SEQ ID NO: 2441 - protein, 8 aa, Homo sapiens
KVVTVLVR

SEQ ID NO: 2442 - protein, 11 aa, Homo sapiens
PVKSDIAPVAR

SEQ ID NO: 2443 - protein, 12 aa, Homo sapiens
GGYTLVSGYPKR

SEQ ID NO: 2444 - protein, 24 aa, Homo sapiens
AFQPFFVELTMPYSVIRGEAFTLK

SEQ ID NO: 2445 - protein, 7 aa, Homo sapiens
VYFFKGK

SEQ ID NO: 2446 - protein, 20 aa, Homo sapiens
QSNNKYAASSYLSLTPEQWK

SEQ ID NO: 2447 - protein, 9 aa, Homo sapiens
VLFYVDSEK

SEQ ID NO: 2448 - protein, 15 aa, Homo sapiens
LQHLENELTHDIITK

SEQ ID NO: 2449 - protein, 18 aa, Homo sapiens
TVAAPSVFIFPPSDEQLK

SEQ ID NO: 2450 - protein, 12 aa, Homo sapiens
VSAQQVQGVHAR

SEQ ID NO: 2451 - protein, 18 aa, Homo sapiens
TTVMVKNEDSLVFVQTDK

SEQ ID NO: 2452 - protein, 15 aa, Homo sapiens
DGFVQDEGTMFPVGK

SEQ ID NO: 2453 - protein, 13 aa, Homo sapiens
LAGAPSEDPQFPK

SEQ ID NO: 2454 - protein, 8 aa, Homo sapiens
DGFFGNPR

SEQ ID NO: 2455 - protein, 12 aa, Homo sapiens
LFWEPMKVHDIR

SEQ ID NO: 2456 - protein, 19 aa, Homo sapiens
MDELRPLIPVLEEYKADAK

SEQ ID NO: 2457 - protein, 14 aa, Homo sapiens
IALGGLLFPASNLR

SEQ ID NO: 2458 - protein, 9 aa, Homo sapiens
SFYTAYLQR

SEQ ID NO: 2459 - protein, 19 aa, Homo sapiens
LYHSEAFTVNFGDTEEAKK

SEQ ID NO: 2460 - protein, 12 aa, Homo sapiens
DLLPASLGSYYR

SEQ ID NO: 2461 - protein, 10 aa, Homo sapiens
VLEKDSVTLK

SEQ ID NO: 2462 - protein, 16 aa, Homo sapiens
GVALHRPDVYLLPPAR

SEQ ID NO: 2463 - protein, 15 aa, Homo sapiens
VFAIPPSFASIFLTK

SEQ ID NO: 2464 - protein, 10 aa, Homo sapiens
VDKFLEDVKK

SEQ ID NO: 2465 - protein, 10 aa, Homo sapiens
LVDKFLEDVK

SEQ ID NO: 2466 - protein, 34 aa, Homo sapiens; identical to SEQ ID NO: 896

SEQ ID NO: 2467 - protein, 12 aa, Homo sapiens
FQGEWNLQPLPK

SEQ ID NO: 2468 - protein, 10 aa, Homo sapiens
PIPNKVIFIR

SEQ ID NO: 2469 - protein, 11 aa, Homo sapiens
VLFYVDSEKLK

SEQ ID NO: 2470 - protein, 18 aa, Homo sapiens
RPSTDTITVMVENSHGLR

SEQ ID NO: 2471 - protein, 8 aa, Homo sapiens
AFTDLHLR

SEQ ID NO: 2472 - protein, 16 aa, Homo sapiens
TALASGGVLDASGDYR

SEQ ID NO: 2473 - protein, 7 aa, Homo sapiens
GDAEAVK

SEQ ID NO: 2474 - protein, 12 aa, Homo sapiens
VQLTGEPVPMAR

SEQ ID NO: 2475 - protein, 17 aa, Homo sapiens
PQPHAEPWAFSLDLGLK

SEQ ID NO: 2476 - protein, 13 aa, Homo sapiens
DTANLFPQTSLTL

SEQ ID NO: 2477 - protein, 11 aa, Homo sapiens
LSGEAYGFVAR

SEQ ID NO: 2478 - protein, 8 aa, Homo sapiens
IFGNYIER

SEQ ID NO: 2479 - protein, 11 aa, Homo sapiens
AASGTQNNVLR

SEQ ID NO: 2480 - protein, 19 aa, Homo sapiens
EGKQVGSGVTTDQVQAEAK

SEQ ID NO: 2481 - protein, 10 aa, Homo sapiens
EVALDLSQHK

SEQ ID NO: 2482 - protein, 10 aa, Homo sapiens
SAVDAGFLQK

SEQ ID NO: 2483 - protein, 14 aa, Homo sapiens
EQQETVLDGNLIIR

SEQ ID NO: 2484 - protein, 16 aa, Homo sapiens
ELSHLPSLYDYSAYRR

SEQ ID NO: 2485 - protein, 12 aa, Homo sapiens
LVDGKGVPIPNK

SEQ ID NO: 2486 - protein, 18 aa, Homo sapiens
GQIHLDPQQDYQLLQVQR

SEQ ID NO: 2487 - protein, 15 aa, Homo sapiens
GILAADESVGTMGNR

SEQ ID NO: 2488 - protein, 10 aa, Homo sapiens
RIDITLSSVK

SEQ ID NO: 2489 - protein, 21 aa, Homo sapiens
TPDVSSALDKLKEFGNTLEDK

SEQ ID NO: 2490 - protein, 21 aa, Homo sapiens
NVPLPVIAELPPKVSVFVPPR

SEQ ID NO: 2491 - protein, 12 aa, Homo sapiens
KVFSGDGKDFYR

SEQ ID NO: 2492 - protein, 6 aa, Homo sapiens
LYSILK

SEQ ID NO: 2493 - protein, 8 aa, Homo sapiens
QIQVSWLR

SEQ ID NO: 2494 - protein, 12 aa, Homo sapiens
VGSALFLSHNLK

SEQ ID NO: 2495 - protein, 6 aa, Homo sapiens
TFAQAR

SEQ ID NO: 2496 - protein, 19 aa, Homo sapiens
AAPSVTLFPPSSEELQANK

SEQ ID NO: 2497 - protein, 23 aa, Homo sapiens
GVQTESSTVTPTLPGETLTYVWK

SEQ ID NO: 2498 - protein, 16 aa, Homo sapiens
VSVFVPPRDGFFGNPR

SEQ ID NO: 2499 - protein, 17 aa, Homo sapiens
LVDGKGVPIPNKVIFIR

SEQ ID NO: 2500 - protein, 12 aa, Homo sapiens
VSSNHVLIYLDK

SEQ ID NO: 2501 - protein, 19 aa, Homo sapiens
SALYSPSDPLTLLQADTVR

SEQ ID NO: 2502 - protein, 6 aa, Homo sapiens
FIAESK

SEQ ID NO: 2503 - protein, 21 aa, Homo sapiens
RLIDQYGTHYLQSGSLGGEYR

SEQ ID NO: 2504 - protein, 23 aa, Homo sapiens
KAGTELVNFLSYFVELGTQPATQ

SEQ ID NO: 2505 - protein, 11 aa, Homo sapiens
ASSLESGVPSR

SEQ ID NO: 2506 - protein, 8 aa, Homo sapiens
APEGFAVR

SEQ ID NO: 2507 - protein, 9 aa, Homo sapiens
FYVDSEKLK

SEQ ID NO: 2508 - protein, 16 aa, Homo sapiens
ESGPTTYKVTSTLTIK

SEQ ID NO: 2509 - protein, 22 aa, Homo sapiens
FNKPFVFLMIEQNTKSPLFMGK

SEQ ID NO: 2510 - protein, 7 aa, Homo sapiens
SPLFMGK

SEQ ID NO: 2511 - protein, 12 aa, Homo sapiens
LKQNDFNSVEEK

SEQ ID NO: 2512 - protein, 11 aa, Homo sapiens
TSHTNEIHKGK

SEQ ID NO: 2513 - protein, 10 aa, Homo sapiens
GVPIPNKVIF

SEQ ID NO: 2514 - protein, 27 aa, Homo sapiens
VSNQTLSLFFTVLQDVPVRDLKPAIVK

SEQ ID NO: 2515 - protein, 11 aa, Homo sapiens
LIVAMSSWLQK

SEQ ID NO: 2516 - protein, 16 aa, Homo sapiens
VLTVLHQDWLNGKEYK

SEQ ID NO: 2517 - protein, 15 aa, Homo sapiens
FNKPFVFLMIEQNTK

SEQ ID NO: 2518 - protein, 8 aa, Homo sapiens
PPSDEQLK

SEQ ID NO: 2519 - protein, 10 aa, Homo sapiens
QNDFNSVEEK

SEQ ID NO: 2520 - protein, 12 aa, Homo sapiens
NNEEYLALIFEK

SEQ ID NO: 2521 - protein, 13 aa, Homo sapiens
KLKEGMLSIMSYR

SEQ ID NO: 2522 - protein, 22 aa, Homo sapiens
GGGAGFISGLSYLELDNPAGNK

SEQ ID NO: 2523 - protein, 18 aa, Homo sapiens
EKDPQPQQLPPMDPKLLK

SEQ ID NO: 2524 - protein, 18 aa, Homo sapiens
HDTSLKPISVSYNPATAK

SEQ ID NO: 2525 - protein, 16 aa, Homo sapiens
FSGSNSGNTATLTISR

SEQ ID NO: 2526 - protein, 20 aa, Homo sapiens
ASGVPDRFSGSGSGTDFTLK

SEQ ID NO: 2527 - protein, 17 aa, Homo sapiens
TLQALEFHTVPFQLLAR

SEQ ID NO: 2528 - protein, 19 aa, Homo sapiens
HTFMGVVSLGSPSGEVSHP

SEQ ID NO: 2529 - protein, 8 aa, Homo sapiens
QPPAWSIR

SEQ ID NO: 2530 - protein, 13 aa, Homo sapiens
VMTPAVYAPYDVK

SEQ ID NO: 2531 - protein, 17 aa, Homo sapiens
TTPPVLDSDGSFFLYSK

SEQ ID NO: 2532 - protein, 7 aa, Homo sapiens
YFHLINR

SEQ ID NO: 2533 - protein, 12 aa, Homo sapiens
YALSHAVNNYHK

SEQ ID NO: 2534 - protein, 20 aa, Homo sapiens
GQPREPQVYTLPPSREEMTK

SEQ ID NO: 2535 - protein, 19 aa, Homo sapiens
EVQLLESGGGLVQPGGSLR

SEQ ID NO: 2536 - protein, 9 aa, Homo sapiens
TITKLSFVK

SEQ ID NO: 2537 - protein, 15 aa, Homo sapiens
SYFEKSKEQLTPLIK

SEQ ID NO: 2538 - protein, 12 aa, Homo sapiens
WLQGSQELPREK

SEQ ID NO: 2539 - protein, 6 aa, Homo sapiens
EIEASK

SEQ ID NO: 2540 - protein, 10 aa, Homo sapiens
TPEGLTLLFK

SEQ ID NO: 2541 - protein, 11 aa, Homo sapiens
AVVFLEPQWYR

SEQ ID NO: 2542 - protein, 13 aa, Homo sapiens
QINDYVEKGTQGK

SEQ ID NO: 2543 - protein, 8 aa, Homo sapiens
WLTFSLGK

SEQ ID NO: 2544 - protein, 8 aa, Homo sapiens
SGWHFVVK

SEQ ID NO: 2545 - protein, 15 aa, Homo sapiens
LTVLHQDWLNGKEYK

SEQ ID NO: 2546 - protein, 17 aa, Homo sapiens
STNYGQAPLSLLVSYTK

SEQ ID NO: 2547 - protein, 14 aa, Homo sapiens
ELSEALGQIFDSQR

SEQ ID NO: 2548 - protein, 13 aa, Homo sapiens
SGTSASLAISGLR

SEQ ID NO: 2549 - protein, 10 aa, Homo sapiens
AVDTWSWGER

SEQ ID NO: 2550 - protein, 12 aa, Homo sapiens
ASHEEVEGLVEK

SEQ ID NO: 2551 - protein, 13 aa, Homo sapiens
YSSDYFQAPSDYR

SEQ ID NO: 2552 - protein, 21 aa, Homo sapiens
VFSNGADLSGVTEEAPLKLSK

SEQ ID NO: 2553 - protein, 25 aa, Homo sapiens
EDPQGDAAQKTDTSHHDQDHPTFNK

SEQ ID NO: 2554 - protein, 19 aa, Homo sapiens
IYTSPTWSAFVTDSSWSAR

SEQ ID NO: 2555 - protein, 17 aa, Homo sapiens
RYSAWAESVTNLPQVIK

SEQ ID NO: 2556 - protein, 26 aa, Homo sapiens
RGENLFAITDEGMDVPLAMEEWHHER

SEQ ID NO: 2557 - protein, 9 aa, Homo sapiens
SSGWHFVVK

SEQ ID NO: 2558 - protein, 13 aa, Homo sapiens
VPPPRDFHINLFR

SEQ ID NO: 2559 - protein, 7 aa, Homo sapiens
YTTEIIK

SEQ ID NO: 2560 - protein, 9 aa, Homo sapiens
IEGHVVIPR

SEQ ID NO: 2561 - protein, 20 aa, Homo sapiens
LIDQYGTHYLQSGSLGGEYR

SEQ ID NO: 2562 - protein, 15 aa, Homo sapiens
TDTSHHDQDHPTFNK

SEQ ID NO: 2563 - protein, 18 aa, Homo sapiens
EIVLTQSPGTLSLSPGER

SEQ ID NO: 2564 - protein, 23 aa, Homo sapiens
ATGIPDRFSGSGSGTDFTLTISR

SEQ ID NO: 2565 - protein, 8 aa, Homo sapiens
SASLHLPK

SEQ ID NO: 2566 - protein, 15 aa, Homo sapiens
DEFKPLVEEPQNLIK

SEQ ID NO: 2567 - protein, 9 aa, Homo sapiens
KSQLVYQSR

SEQ ID NO: 2568 - protein, 17 aa, Homo sapiens
AASGTQNNVLRGEPFIR

SEQ ID NO: 2569 - protein, 18 aa, Homo sapiens
DIQMTQSPSSLSASVGDR

SEQ ID NO: 2570 - protein, 21 aa, Homo sapiens
YYPYQSFQTPQHPSFLFQDKR

SEQ ID NO: 2571 - protein, 15 aa, Homo sapiens
MSSINADFAFNLYRR

SEQ ID NO: 2572 - protein, 10 aa, Homo sapiens
RLSEDYGVLK

SEQ ID NO: 2573 - protein, 39 aa, Homo sapiens
EDPQGDAAQKTDTSHHDQDHPTFNKITPNLAEFAFSLYR

SEQ ID NO: 2574 - protein, 7 aa, Homo sapiens
PLYELVK

SEQ ID NO: 2575 - protein, 17 aa, Homo sapiens
SVLTVLHQDWLNGKEYK

SEQ ID NO: 2576 - protein, 11 aa, Homo sapiens
LVDKFLEDVKK

SEQ ID NO: 2577 - protein, 11 aa, Homo sapiens
VFSGDGKDFYR

SEQ ID NO: 2578 - protein, 11 aa, Homo sapiens
YYTVFDRDNNR

SEQ ID NO: 2579 - protein, 9 aa, Homo sapiens
LTPLYELVK

SEQ ID NO: 2580 - protein, 7 aa, Homo sapiens
DTLMISR

SEQ ID NO: 2581 - protein, 31 aa, Homo sapiens; identical to SEQ ID NO: 1021

SEQ ID NO: 2582 - protein, 18 aa, Homo sapiens
WLPSSSPVTGYRVTTTPK

SEQ ID NO: 2583 - protein, 20 aa, Homo sapiens
DSGVPDRFSGSGSGTDFTLK

SEQ ID NO: 2584 - protein, 16 aa, Homo sapiens
YSAWAESVTNLPQVIK

SEQ ID NO: 2585 - protein, 18 aa, Homo sapiens
YKEENDDFASFRVDRIER

SEQ ID NO: 2586 - protein, 38 aa, Homo sapiens; identical to SEQ ID NO: 1256

SEQ ID NO: 2587 - protein, 22 aa, Homo sapiens
VLFYVDSEKLKQNDFNSVEEKK

SEQ ID NO: 2588 - protein, 22 aa, Homo sapiens
GFYPSDIAVEWESNGQPENNYK

SEQ ID NO: 2589 - protein, 17 aa, Homo sapiens
TTPPMLDSDGSFFLYSK

SEQ ID NO: 2590 - protein, 21 aa, Homo sapiens
ASQSVSSYLAWYQQKPGQAPR

SEQ ID NO: 2591 - protein, 25 aa, Homo sapiens
SLLSNVEGDNAVPMQHNNRPTQPLK

SEQ ID NO: 2592 - protein, 8 aa, Homo sapiens
ALPAPIEK

SEQ ID NO: 2593 - protein, 10 aa, Homo sapiens
SVLGQLGITK

SEQ ID NO: 2594 - protein, 10 aa, Homo sapiens
KLSSWVLLMK

SEQ ID NO: 2595 - protein, 10 aa, Homo sapiens
LSITGTYDLK

SEQ ID NO: 2596 - protein, 21 aa, Homo sapiens
VLFYVDSEKLKQNDFNSVEEK

SEQ ID NO: 2597 - protein, 9 aa, Homo sapiens
LSSWVLLMK

SEQ ID NO: 2598 - protein, 23 aa, Homo sapiens
GGGAGFISGLSYLELDNPAGNKR

SEQ ID NO: 2599 - protein, 11 aa, Homo sapiens
GSALFLSHNLK

SEQ ID NO: 2600 - protein, 9 aa, Homo sapiens
PGGTPTAIK

SEQ ID NO: 2601 - protein, 23 aa, Homo sapiens
IVDLVKELDRDTVFALVNYIFFK

SEQ ID NO: 2602 - protein, 11 aa, Homo sapiens
QKLTPLYELVK

SEQ ID NO: 2603 - protein, 17 aa, Homo sapiens
ELDRDTVFALVNYIFFK

SEQ ID NO: 2604 - protein, 18 aa, Homo sapiens
EIVMTQSPATLSVSPGER

SEQ ID NO: 2605 - protein, 9 aa, Homo sapiens
LLIYGASSR

SEQ ID NO: 2606 - protein, 14 aa, Homo sapiens
ITPNLAEFAFSLYR

SEQ ID NO: 2607 - protein, 18 aa, Homo sapiens
DIVMTQSPDSLAVSLGER

SEQ ID NO: 2608 - protein, 8 aa, Homo sapiens
DDNPNLPR

SEQ ID NO: 2609 - protein, 13 aa, Homo sapiens
SKAIGYLNTGYQR

SEQ ID NO: 2610 - protein, 18 aa, Homo sapiens
EIVLTQSPATLSLSPGER

SEQ ID NO: 2611 - protein, 9 aa, Homo sapiens
LLIYDASNR

SEQ ID NO: 2612 - protein, 8 aa, Homo sapiens
LTVLSQPK

SEQ ID NO: 2613 - protein, 10 aa, Homo sapiens
GFSPKDVLVR

SEQ ID NO: 2614 - protein, 10 aa, Homo sapiens
SVFPLAPSSK

SEQ ID NO: 2615 - protein, 9 aa, Homo sapiens
PYFPVAVGK

SEQ ID NO: 2616 - protein, 12 aa, Homo sapiens
WYVDGVEVHNAK

SEQ ID NO: 2617 - protein, 9 aa, Homo sapiens
FEVQVTVPK

SEQ ID NO: 2618 - protein, 9 aa, Homo sapiens
IVDLVSELK

SEQ ID NO: 2619 - protein, 9 aa, Homo sapiens
LLIYGATSR

SEQ ID NO: 2620 - protein, 11 aa, Homo sapiens
EPQVYTLPPSR

SEQ ID NO: 2621 - protein, 22 aa, Homo sapiens
LTVAAPPSGGPGFLSIERPDSR

SEQ ID NO: 2622 - protein, 19 aa, Homo sapiens
SYELTQPPSVSVSPGQTAR

SEQ ID NO: 2623 - protein, 18 aa, Homo sapiens
SELTQDPAVSVALGQTVR

SEQ ID NO: 2624 - protein, 10 aa, Homo sapiens
SQYAAYGEKK

SEQ ID NO: 2625 - protein, 18 aa, Homo sapiens
APELLGGPSVFLFPPKPK

SEQ ID NO: 2626 - protein, 11 aa, Homo sapiens
WLAWYQQKPGK

SEQ ID NO: 2627 - protein, 12 aa, Homo sapiens
TEQWSTLPPETK

SEQ ID NO: 2628 - protein, 12 aa, Homo sapiens
VSNKGLPAPIEK

SEQ ID NO: 2629 - protein, 19 aa, Homo sapiens
FFESFGDLSTPDAVMGNPK

SEQ ID NO: 2630 - protein, 12 aa, Homo sapiens
VVAGVANALAHK

SEQ ID NO: 2631 - protein, 12 aa, Homo sapiens
VSNKALPAPIEK

SEQ ID NO: 2632 - protein, 8 aa, Homo sapiens
EAANVVVK

SEQ ID NO: 2633 - protein, 8 aa, Homo sapiens
PSVQINFK

SEQ ID NO: 2634 - protein, 8 aa, Homo sapiens
AAEAGVSK

SEQ ID NO: 2635 - protein, 9 aa, Homo sapiens
AAGAFQGLR

SEQ ID NO: 2636 - protein, 7 aa, Homo sapiens
AAIQALR

SEQ ID NO: 2637 - protein, 12 aa, Homo sapiens
AAISGENAGLVR

SEQ ID NO: 2638 - protein, 12 aa, Homo sapiens
AALKTASDFITK

SEQ ID NO: 2639 - protein, 14 aa, Homo sapiens
AAMVGMLANFLGFR

SEQ ID NO: 2640 - protein, 14 aa, Homo sapiens
AANKEATQEAFMKR

SEQ ID NO: 2641 - protein, 16 aa, Homo sapiens
AAPEASGTPSSDAVSR

SEQ ID NO: 2642 - protein, 19 aa, Homo sapiens
AAPSVTLFPPSSEELQANK

SEQ ID NO: 2643 - protein, 11 aa, Homo sapiens
AASGTQNNVLR

SEQ ID NO: 2644 - protein, 17 aa, Homo sapiens
AASGTQNNVLRGEPFIR

SEQ ID NO: 2645 - protein, 13 aa, Homo sapiens
AASGTTGTYQEWK

SEQ ID NO: 2646 - protein, 15 aa, Homo sapiens
AASGTTGTYQEWKDK

SEQ ID NO: 2647 - protein, 15 aa, Homo sapiens
AATVGSLAGQPLQER

SEQ ID NO: 2648 - protein, 12 aa, Homo sapiens
AAVSNFGYDLYR

SEQ ID NO: 2649 - protein, 12 aa, Homo sapiens
ADDTWEPFASGK

SEQ ID NO: 2650 - protein, 12 aa, Homo sapiens
ADGLAVIGVLMK

SEQ ID NO: 2651 - protein, 11 aa, Homo sapiens
ADHDALLFHLK

SEQ ID NO: 2652 - protein, 13 aa, Homo sapiens
ADKPLSIHPQGIR

SEQ ID NO: 2653 - protein, 35 aa, Homo sapiens; identical to SEQ ID NO: 107

SEQ ID NO: 2654 - protein, 16 aa, Homo sapiens
ADLFYDVEALDLESPK

SEQ ID NO: 2655 - protein, 10 aa, Homo sapiens
ADLSGITGAR

SEQ ID NO: 2656 - protein, 17 aa, Homo sapiens
ADMVGTFTDTEDPAKFK

SEQ ID NO: 2657 - protein, 36 aa, Homo sapiens
ADNFLLENTLPAQSTFTLAISAYALSLGDKTHPQFR

SEQ ID NO: 2658 - protein, 16 aa, Homo sapiens
ADSGEGDFLAEGGGVR

SEQ ID NO: 2659 - protein, 9 aa, Homo sapiens
ADSIQGTAR

SEQ ID NO: 2660 - protein, 24 aa, Homo sapiens
ADSQAQLLLSTVVGVFTAPGLHLK

SEQ ID NO: 2661 - protein, 17 aa, Homo sapiens
ADSSPVKAGVETTTPSK

SEQ ID NO: 2662 - protein, 15 aa, Homo sapiens
ADTAKEVSFDVELPK

SEQ ID NO: 2663 - protein, 25 aa, Homo sapiens
ADVKGHGATNDLTFTEEVDMKEMEK

SEQ ID NO: 2664 - protein, 6 aa, Homo sapiens
AEALIR

SEQ ID NO: 2665 - protein, 21 aa, Homo sapiens
AEATTLHVAPQGTAMAVSTFR

SEQ ID NO: 2666 - protein, 15 aa, Homo sapiens
AEDHFSVIDFNQNIR

SEQ ID NO: 2667 - protein, 22 aa, Homo sapiens
AEEEHLGILGPQLHADVGDKVK

SEQ ID NO: 2668 - protein, 9 aa, Homo sapiens
AEFQDALEK

SEQ ID NO: 2669 - protein, 21 aa, Homo sapiens
AEFQDALEKLNMGITDLQGLR

SEQ ID NO: 2670 - protein, 8 aa, Homo sapiens
AEIEYLEK

SEQ ID NO: 2671 - protein, 10 aa, Homo sapiens
AEKSHDELPR

SEQ ID NO: 2672 - protein, 15 aa, Homo sapiens
AELGGHLDQQVEEFR

SEQ ID NO: 2673 - protein, 16 aa, Homo sapiens
AELGGHLDQQVEEFRR

SEQ ID NO: 2674 - protein, 12 aa, Homo sapiens
AETGDKVYVHLK

SEQ ID NO: 2675 - protein, 10 aa, Homo sapiens
AEVYVVPWEK

SEQ ID NO: 2676 - protein, 12 aa, Homo sapiens
AFIQLWAFDAVK

SEQ ID NO: 2677 - protein, 20 aa, Homo sapiens
AFKEAEFGQGTGPIWLNEVK

SEQ ID NO: 2678 - protein, 18 aa, Homo sapiens
AFLNGALDGVILGDYLSR

SEQ ID NO: 2679 - protein, 19 aa, Homo sapiens
AFPALTSLDLSDNPGLGER

SEQ ID NO: 2680 - protein, 17 aa, Homo sapiens
AFQPFFVELTMPYSVIR

SEQ ID NO: 2681 - protein, 24 aa, Homo sapiens
AFQPFFVELTMPYSVIRGEAFTLK

SEQ ID NO: 2682 - protein, 7 aa, Homo sapiens
AFQYHSK

SEQ ID NO: 2683 - protein, 7 aa, Homo sapiens
AFSSYQK

SEQ ID NO: 2684 - protein, 6 aa, Homo sapiens
AFTNSK

SEQ ID NO: 2685 - protein, 10 aa, Homo sapiens
AFWLDVSHNR

SEQ ID NO: 2686 - protein, 24 aa, Homo sapiens
AFWLDVSHNRLEALPNSLLAPLGR

SEQ ID NO: 2687 - protein, 19 aa, Homo sapiens
AFYYPEEAGLAFGGPGSSR

SEQ ID NO: 2688 - protein, 8 aa, Homo sapiens
AGAFQGLR

SEQ ID NO: 2689 - protein, 13 aa, Homo sapiens
AGALNSNDAFVLK

SEQ ID NO: 2690 - protein, 39 aa, Homo sapiens
AGALNSNDAFVLKTPSAAYLWVGTGASEAEKTGAQELLR

SEQ ID NO: 2691 - protein, 14 aa, Homo sapiens
AGDFLEANYMNLQR

SEQ ID NO: 2692 - protein, 10 aa, Homo sapiens
AGEVQEPELR

SEQ ID NO: 2693 - protein, 10 aa, Homo sapiens
AGFAGDDAPR

SEQ ID NO: 2694 - protein, 40 aa, Homo sapiens; identical to SEQ ID NO: 427

SEQ ID NO: 2695 - protein, 11 aa, Homo sapiens
AGFSWIEVTFK

SEQ ID NO: 2696 - protein, 12 aa, Homo sapiens
AGGSWDLAVQER

SEQ ID NO: 2697 - protein, 11 aa, Homo sapiens
AGKEPGLQIWR

SEQ ID NO: 2698 - protein, 16 aa, Homo sapiens
AGLAASLAGPHSIVGR

SEQ ID NO: 2699 - protein, 14 aa, Homo sapiens
AGLLRPDYALLGHR

SEQ ID NO: 2700 - protein, 22 aa, Homo sapiens
AGTELVNFLSYFVELGTQPATQ

SEQ ID NO: 2701 - protein, 11 aa, Homo sapiens
AGTRQPQFISR

SEQ ID NO: 2702 - protein, 10 aa, Homo sapiens
AGVETTTPSK

SEQ ID NO: 2703 - protein, 7 aa, Homo sapiens
AGVLKEK

SEQ ID NO: 2704 - protein, 9 aa, Homo sapiens
AGYQSTLTR

SEQ ID NO: 2705 - protein, 7 aa, Homo sapiens
AGYVLHR

SEQ ID NO: 2706 - protein, 20 aa, Homo sapiens
AHFSPSNIILDFPAAGSAAR

SEQ ID NO: 2707 - protein, 19 aa, Homo sapiens
AHGNVAEGETKPDPDVTER

SEQ ID NO: 2708 - protein, 25 aa, Homo sapiens
AHGVQTESSTVTPTLPGETLTYVWK

SEQ ID NO: 2709 - protein, 10 aa, Homo sapiens
AHLAWLNQGK

SEQ ID NO: 2710 - protein, 19 aa, Homo sapiens
AHNSVGSGSWAFIPISAGA

SEQ ID NO: 2711 - protein, 13 aa, Homo sapiens
AHVSFKPTVAQQR

SEQ ID NO: 2712 - protein, 6 aa, Homo sapiens
AHYDLR

SEQ ID NO: 2713 - protein, 12 aa, Homo sapiens
AIEDYINEFSVR

SEQ ID NO: 2714 - protein, 13 aa, Homo sapiens
AIEDYINEFSVRK

SEQ ID NO: 2715 - protein, 13 aa, Homo sapiens
AIFSVGPVSPSRR

SEQ ID NO: 2716 - protein, 10 aa, Homo sapiens
AIFYMNNPSR

SEQ ID NO: 2717 - protein, 21 aa, Homo sapiens
AILQSGSFNAPWAVTSLYEAR

SEQ ID NO: 2718 - protein, 10 aa, Homo sapiens
AIMEKLEMSK

SEQ ID NO: 2719 - protein, 16 aa, Homo sapiens
AINEKLGQYASPTAKR

SEQ ID NO: 2720 - protein, 11 aa, Homo sapiens
AINVAVHVFRK

SEQ ID NO: 2721 - protein, 28 aa, Homo sapiens
AISGGSIQIENGYFVHYFAPEGLTTMPK

SEQ ID NO: 2722 - protein, 22 aa, Homo sapiens
AITVFSPDGHLFQVEYAQEAVK

SEQ ID NO: 2723 - protein, 12 aa, Homo sapiens
AKDLHLSDVFLK

SEQ ID NO: 2724 - protein, 12 aa, Homo sapiens
AKFEELNMDLFR

SEQ ID NO: 2725 - protein, 17 aa, Homo sapiens
AKGKEESLDSDLYAELR

SEQ ID NO: 2726 - protein, 11 aa, Homo sapiens
AKIDQNVEELK

SEQ ID NO: 2727 - protein, 13 aa, Homo sapiens
AKIDQNVEELKGR

SEQ ID NO: 2728 - protein, 11 aa, Homo sapiens
AKIEVSEDGTK

SEQ ID NO: 2729 - protein, 11 aa, Homo sapiens
AKLEEQAQQIR

SEQ ID NO: 2730 - protein, 17 aa, Homo sapiens
AKLGNFPWQAFTSIHGR

SEQ ID NO: 2731 - protein, 15 aa, Homo sapiens
AKLHIDEMDSVPTVR

SEQ ID NO: 2732 - protein, 11 aa, Homo sapiens
AKNQVVIAAGR

SEQ ID NO: 2733 - protein, 26 aa, Homo sapiens
AKSPPTMVDSLLAVTLAGNLGLTFLR

SEQ ID NO: 2734 - protein, 19 aa, Homo sapiens
AKVFKDVFLEMNIPYSVVR

SEQ ID NO: 2735 - protein, 26 aa, Homo sapiens
AKVFKDVFLEMNIPYSVVRGEQIQLK

SEQ ID NO: 2736 - protein, 12 aa, Homo sapiens
AKVQPYLDDFQK

SEQ ID NO: 2737 - protein, 16 aa, Homo sapiens
AKWEMPFDPQDTHQSR

SEQ ID NO: 2738 - protein, 8 aa, Homo sapiens
ALADGVQK

SEQ ID NO: 2739 - protein, 22 aa, Homo sapiens
ALALPPLGLAPLLNLWAKPQGR

SEQ ID NO: 2740 - protein, 11 aa, Homo sapiens
ALDFAVGEYNK

SEQ ID NO: 2741 - protein, 8 aa, Homo sapiens
ALDLINKR

SEQ ID NO: 2742 - protein, 7 aa, Homo sapiens
ALDLSLK

SEQ ID NO: 2743 - protein, 8 aa, Homo sapiens
ALDMENFR

SEQ ID NO: 2744 - protein, 11 aa, Homo sapiens
ALEFLQLHNGR

SEQ ID NO: 2745 - protein, 19 aa, Homo sapiens
ALEILQEEDLIDEDDIPVR

SEQ ID NO: 2746 - protein, 16 aa, Homo sapiens
ALEKYKEENDDFASFR

SEQ ID NO: 2747 - protein, 19 aa, Homo sapiens
ALEKYKEENDDFASFRVDR

SEQ ID NO: 2748 - protein, 11 aa, Homo sapiens
ALEQDLPVNIK

SEQ ID NO: 2749 - protein, 9 aa, Homo sapiens
ALFVSEEEK

SEQ ID NO: 2750 - protein, 10 aa, Homo sapiens
ALFVSEEEKK

SEQ ID NO: 2751 - protein, 13 aa, Homo sapiens
ALFVSEEEKKLTR

SEQ ID NO: 2752 - protein, 11 aa, Homo sapiens
ALGHLDLSGNR

SEQ ID NO: 2753 - protein, 13 aa, Homo sapiens
ALGHLDLSGNRLR

SEQ ID NO: 2754 - protein, 23 aa, Homo sapiens
ALGISPFHEHAEVVFTANDSGPR

SEQ ID NO: 2755 - protein, 14 aa, Homo sapiens
ALHQVFEHMLDVSK

SEQ ID NO: 2756 - protein, 9 aa, Homo sapiens
ALIYSTSNK

SEQ ID NO: 2757 - protein, 18 aa, Homo sapiens
ALKYEVQGEVFTKPQLWP

SEQ ID NO: 2758 - protein, 11 aa, Homo sapiens
ALLEVVQSGGK

SEQ ID NO: 2759 - protein, 14 aa, Homo sapiens
ALLVHGGHRPSTAR

SEQ ID NO: 2760 - protein, 11 aa, Homo sapiens
ALMDETMKELK

SEQ ID NO: 2761 - protein, 10 aa, Homo sapiens
ALMSPAGMLR

SEQ ID NO: 2762 - protein, 16 aa, Homo sapiens
ALNHLPLEYNSALYSR

SEQ ID NO: 2763 - protein, 8 aa, Homo sapiens
ALPTTYEK

SEQ ID NO: 2764 - protein, 13 aa, Homo sapiens
ALQASALAAWGGK

SEQ ID NO: 2765 - protein, 11 aa, Homo sapiens
ALQATVGNSYK

SEQ ID NO: 2766 - protein, 12 aa, Homo sapiens
ALQDQLVLVAAK

SEQ ID NO: 2767 - protein, 20 aa, Homo sapiens
ALQDQLVLVAAKLDTEDKLR

SEQ ID NO: 2768 - protein, 15 aa, Homo sapiens
ALQERDYIFGNYIER

SEQ ID NO: 2769 - protein, 7 aa, Homo sapiens
ALQEYRK

SEQ ID NO: 2770 - protein, 15 aa, Homo sapiens
ALRDFALQNPSAVPR

SEQ ID NO: 2771 - protein, 14 aa, Homo sapiens
ALTSELANARDESK

SEQ ID NO: 2772 - protein, 17 aa, Homo sapiens
ALVAIDYINQNLPWGYK

SEQ ID NO: 2773 - protein, 10 aa, Homo sapiens
ALVQQMEQLR

SEQ ID NO: 2774 - protein, 11 aa, Homo sapiens
ALWEKPFISSR

SEQ ID NO: 2775 - protein, 7 aa, Homo sapiens
ALYAQAR

SEQ ID NO: 2776 - protein, 12 aa, Homo sapiens
ALYLQYTDETFR

SEQ ID NO: 2777 - protein, 9 aa, Homo sapiens
ALYVHGGYK

SEQ ID NO: 2778 - protein, 15 aa, Homo sapiens
ALYWVNGQVPDGVSK

SEQ ID NO: 2779 - protein, 17 aa, Homo sapiens
ALYYDLISSPDIHGTYK

SEQ ID NO: 2780 - protein, 28 aa, Homo sapiens
ALYYDLISSPDIHGTYKELLDTVTAPQK

SEQ ID NO: 2781 - protein, 18 aa, Homo sapiens
AMVGSDVELSCACPEGSR

SEQ ID NO: 2782 - protein, 19 aa, Homo sapiens
ANAGKPKDPTFIPAPIQAK

SEQ ID NO: 2783 - protein, 7 aa, Homo sapiens
ANEVSQK

SEQ ID NO: 2784 - protein, 6 aa, Homo sapiens
ANLFNK

SEQ ID NO: 2785 - protein, 12 aa, Homo sapiens
ANLFNKLVTELR

SEQ ID NO: 2786 - protein, 10 aa, Homo sapiens
ANRPFLVFIR

SEQ ID NO: 2787 - protein, 8 aa, Homo sapiens
ANSFLGEK

SEQ ID NO: 2788 - protein, 10 aa, Homo sapiens
ANTFLEEVRK

SEQ ID NO: 2789 - protein, 16 aa, Homo sapiens
APEAQVSVQPNFQQDK

SEQ ID NO: 2790 - protein, 15 aa, Homo sapiens
APGELEHGLITFSTR

SEQ ID NO: 2791 - protein, 10 aa, Homo sapiens
APHGPGLIYR

SEQ ID NO: 2792 - protein, 11 aa, Homo sapiens
APKVVEEQESR

SEQ ID NO: 2793 - protein, 7 aa, Homo sapiens
APLEGAR

SEQ ID NO: 2794 - protein, 9 aa, Homo sapiens
APNSGPHNR

SEQ ID NO: 2795 - protein, 21 aa, Homo sapiens
APPSGGPGFLSIERPDSRPPR

SEQ ID NO: 2796 - protein, 12 aa, Homo sapiens
APSTWLTAYVVK

SEQ ID NO: 2797 - protein, 7 aa, Homo sapiens
APTAAAK

SEQ ID NO: 2798 - protein, 13 aa, Homo sapiens
APVSFENGIYTPR

SEQ ID NO: 2799 - protein, 23 aa, Homo sapiens
APYAQDTQEKLNHQLEGLTFQMK

SEQ ID NO: 2800 - protein, 20 aa, Homo sapiens
AQDTQEKLNHQLEGLTFQMK

SEQ ID NO: 2801 - protein, 13 aa, Homo sapiens
AQEPVHLDSPAIK

SEQ ID NO: 2802 - protein, 25 aa, Homo sapiens
AQEPVHLDSPAIKHQFLLTGDTQGR

SEQ ID NO: 2803 - protein, 10 aa, Homo sapiens
AQGYSGLSVK

SEQ ID NO: 2804 - protein, 15 aa, Homo sapiens
AQIINDAFNLASAHK

SEQ ID NO: 2805 - protein, 7 aa, Homo sapiens
AQITGYR

SEQ ID NO: 2806 - protein, 13 aa, Homo sapiens
AQLGDLPWQVAIK

SEQ ID NO: 2807 - protein, 22 aa, Homo sapiens
AQPVQVAEGSEPDGFWEALGGK

SEQ ID NO: 2808 - protein, 14 aa, Homo sapiens
AQVSPTASDMLHMR

SEQ ID NO: 2809 - protein, 22 aa, Homo sapiens
AQWANPFDPSKTEDSSSFLIDK

SEQ ID NO: 2810 - protein, 13 aa, Homo sapiens
AQYVLISPEASSR

SEQ ID NO: 2811 - protein, 26 aa, Homo sapiens
ARAEVSADQVATVMWDYFSQLSNNAK

SEQ ID NO: 2812 - protein, 11 aa, Homo sapiens
AREDIFMETLK

SEQ ID NO: 2813 - protein, 10 aa, Homo sapiens
AREEHRIPER

SEQ ID NO: 2814 - protein, 41 aa, Homo sapiens
ARVHVSEEGTEPEAMLQVLGPKPALPAGTEDTAKEDAANRK

SEQ ID NO: 2815 - protein, 9 aa, Homo sapiens
ARVQVVAGK

SEQ ID NO: 2816 - protein, 20 aa, Homo sapiens
ASGVPDRFSGSGSGTDFTLK

SEQ ID NO: 2817 - protein, 12 aa, Homo sapiens
ASHEEVEGLVEK

SEQ ID NO: 2818 - protein, 13 aa, Homo sapiens
ASLKYENYELTLK

SEQ ID NO: 2819 - protein, 24 aa, Homo sapiens
ASLLTMAFLNGALDGVILGDYLSR

SEQ ID NO: 2820 - protein, 13 aa, Homo sapiens
ASLRPHADELKAK

SEQ ID NO: 2821 - protein, 9 aa, Homo sapiens
ASNDMYHSR

SEQ ID NO: 2822 - protein, 17 aa, Homo sapiens
ASQHGSDVVIETDFGLR

SEQ ID NO: 2823 - protein, 21 aa, Homo sapiens
ASQSVSSYLAWYQQKPGQAPR

SEQ ID NO: 2824 - protein, 16 aa, Homo sapiens
ASRPYTFHSHGITYYK

SEQ ID NO: 2825 - protein, 12 aa, Homo sapiens
ASSIIDELFQDR

SEQ ID NO: 2826 - protein, 16 aa, Homo sapiens
ASSIIDELFQDRFFTR

SEQ ID NO: 2827 - protein, 21 aa, Homo sapiens
ASSIIDELFQDRFFTREPQDT

SEQ ID NO: 2828 - protein, 31 aa, Homo sapiens
ASSIIDELFQDRFFTREPQDTYHYLPFSLPH

SEQ ID NO: 2829 - protein, 11 aa, Homo sapiens
ASSLESGVPSR

SEQ ID NO: 2830 - protein, 18 aa, Homo sapiens
ASSQWVVGPSYFVEYLIK

SEQ ID NO: 2831 - protein, 14 aa, Homo sapiens
ASVSVTAEDEGTQR

SEQ ID NO: 2832 - protein, 8 aa, Homo sapiens
ASYGVKPR

SEQ ID NO: 2833 - protein, 17 aa, Homo sapiens
ATEDEGSEQKIPEATNR

SEQ ID NO: 2834 - protein, 11 aa, Homo sapiens
ATEHLSTLSEK

SEQ ID NO: 2835 - protein, 9 aa, Homo sapiens
ATFNPAQDK

SEQ ID NO: 2836 - protein, 23 aa, Homo sapiens
ATGIPDRFSGSGSGTDFTLTISR

SEQ ID NO: 2837 - protein, 22 aa, Homo sapiens
ATGVLYDYVNKYHWEHTGLTLR

SEQ ID NO: 2838 - protein, 9 aa, Homo sapiens
ATIKSESGF

SEQ ID NO: 2839 - protein, 15 aa, Homo sapiens
ATISHVSPDSLYLFR

SEQ ID NO: 2840 - protein, 21 aa, Homo sapiens
ATLDVDEAGTEAAAATSFAIK

SEQ ID NO: 2841 - protein, 14 aa, Homo sapiens
ATLGPAVRPLPWQR

SEQ ID NO: 2842 - protein, 8 aa, Homo sapiens
ATLLDIYK

SEQ ID NO: 2843 - protein, 24 aa, Homo sapiens
ATLLDIYKTGEAVAEKDSEITFIK

SEQ ID NO: 2844 - protein, 25 aa, Homo sapiens
ATLLDIYKTGEAVAEKDSEITFIKK

SEQ ID NO: 2845 - protein, 15 aa, Homo sapiens
ATLYALSHAVNNYHK

SEQ ID NO: 2846 - protein, 6 aa, Homo sapiens
ATQVSK

SEQ ID NO: 2847 - protein, 14 aa, Homo sapiens
ATVGSLAGQPLQER

SEQ ID NO: 2848 - protein, 9 aa, Homo sapiens
ATVLNYLPK

SEQ ID NO: 2849 - protein, 9 aa, Homo sapiens
ATVVYQGER

SEQ ID NO: 2850 - protein, 11 aa, Homo sapiens
ATWSGAVLAGR

SEQ ID NO: 2851 - protein, 8 aa, Homo sapiens
ATYIQNYR

SEQ ID NO: 2852 - protein, 10 aa, Homo sapiens
AVAEPGIQLK

SEQ ID NO: 2853 - protein, 13 aa, Homo sapiens
AVAGNISDPGLQK

SEQ ID NO: 2854 - protein, 8 aa, Homo sapiens
AVASFLRR

SEQ ID NO: 2855 - protein, 8 aa, Homo sapiens
AVDAALKK

SEQ ID NO: 2856 - protein, 13 aa, Homo sapiens
AVDLIPWMEYEFR

SEQ ID NO: 2857 - protein, 10 aa, Homo sapiens
AVDTWSWGER

SEQ ID NO: 2858 - protein, 11 aa, Homo sapiens
AVEPQLQEEER

SEQ ID NO: 2859 - protein, 7 aa, Homo sapiens
AVEVLPK

SEQ ID NO: 2860 - protein, 11 aa, Homo sapiens
AVFPSIVGRPR

SEQ ID NO: 2861 - protein, 7 aa, Homo sapiens
AVGGLGK

SEQ ID NO: 2862 - protein, 18 aa, Homo sapiens
AVGSGATFSHYYYMILSR

SEQ ID NO: 2863 - protein, 21 aa, Homo sapiens
AVIQHFQEKVESLEQEAANER

SEQ ID NO: 2864 - protein, 12 aa, Homo sapiens
AVISPGFDVFAK

SEQ ID NO: 2865 - protein, 13 aa, Homo sapiens
AVISPGFDVFAKK

SEQ ID NO: 2866 - protein, 19 aa, Homo sapiens
AVLDVFEEGTEASAATAVK

SEQ ID NO: 2867 - protein, 30 aa, Homo sapiens
AVLDVFEEGTEASAATAVKITLLSALVETR

SEQ ID NO: 2868 - protein, 8 aa, Homo sapiens
AVLHIGEK

SEQ ID NO: 2869 - protein, 8 aa, Homo sapiens
AVLTIDEK

SEQ ID NO: 2870 - protein, 19 aa, Homo sapiens
AVNRADTAKEVSFDVELPK

SEQ ID NO: 2871 - protein, 24 aa, Homo sapiens
AVPHPDSQPDTIDHDLLLLQLSEK

SEQ ID NO: 2872 - protein, 25 aa, Homo sapiens
AVPPNNSNAAEDDLPTVELQGVVPR

SEQ ID NO: 2873 - protein, 8 aa, Homo sapiens
AVRPGYPK

SEQ ID NO: 2874 - protein, 15 aa, Homo sapiens
AVSMPSFSILGSDVR

SEQ ID NO: 2875 - protein, 8 aa, Homo sapiens
AVSQVVHK

SEQ ID NO: 2876 - protein, 17 aa, Homo sapiens
AVSSFDPEIDLSNQSGR

SEQ ID NO: 2877 - protein, 14 aa, Homo sapiens
AWGESTPLANKPGK

SEQ ID NO: 2878 - protein, 20 aa, Homo sapiens
AYISMHSYSQHIVFPYSYTR

SEQ ID NO: 2879 - protein, 7 aa, Homo sapiens
AYSDLSR

SEQ ID NO: 2880 - protein, 12 aa, Homo sapiens
AYSLFSYNTQGR

SEQ ID NO: 2881 - protein, 20 aa, Homo sapiens
AYSLFSYNTQGRDNELLVYK

SEQ ID NO: 2882 - protein, 6 aa, Homo sapiens
DAAIKK

SEQ ID NO: 2883 - protein, 10 aa, Homo sapiens
DADPDTFFAK

SEQ ID NO: 2884 - protein, 9 aa, Homo sapiens
DAGAIAGLK

SEQ ID NO: 2885 - protein, 9 aa, Homo sapiens
DALSASVVK

SEQ ID NO: 2886 - protein, 18 aa, Homo sapiens
DAPDHQELNLDVSLQLPS

SEQ ID NO: 2887 - protein, 10 aa, Homo sapiens
DAQYAPGYDK

SEQ ID NO: 2888 - protein, 12 aa, Homo sapiens
DAQYAPGYDKVK

SEQ ID NO: 2889 - protein, 21 aa, Homo sapiens
DAQYAPGYDKVKDISEVVTPR

SEQ ID NO: 2890 - protein, 17 aa, Homo sapiens
DDDLEHQGGHVLDHGHK

SEQ ID NO: 2891 - protein, 10 aa, Homo sapiens
DEDGKKTFFR

SEQ ID NO: 2892 - protein, 6 aa, Homo sapiens
DEDGYR

SEQ ID NO: 2893 - protein, 12 aa, Homo sapiens
DEDMNSFKADVK

SEQ ID NO: 2894 - protein, 10 aa, Homo sapiens
DFDFVPPVVR

SEQ ID NO: 2895 - protein, 18 aa, Homo sapiens
DFEQPFINKPDTLLVNRK

SEQ ID NO: 2896 - protein, 14 aa, Homo sapiens
DFHINLFQVLPWLK

SEQ ID NO: 2897 - protein, 8 aa, Homo sapiens
DFHINLFR

SEQ ID NO: 2898 - protein, 12 aa, Homo sapiens
DFLGFYVVDSHR

SEQ ID NO: 2899 - protein, 20 aa, Homo sapiens
DFQPVLHLVALNSPLSGGMR

SEQ ID NO: 2900 - protein, 13 aa, Homo sapiens
DFSSQADLRNEIK

SEQ ID NO: 2901 - protein, 14 aa, Homo sapiens
DFTELDVAAEKIDR

SEQ ID NO: 2902 - protein, 8 aa, Homo sapiens
DFVQPPTK

SEQ ID NO: 2903 - protein, 10 aa, Homo sapiens
DGAGDVAFVK

SEQ ID NO: 2904 - protein, 15 aa, Homo sapiens
DGFVQDEGTMFPVGK

SEQ ID NO: 2905 - protein, 10 aa, Homo sapiens
DGLKYHYLIR

SEQ ID NO: 2906 - protein, 9 aa, Homo sapiens
DGNDHSLWR

SEQ ID NO: 2907 - protein, 11 aa, Homo sapiens
DGNPFYFTDHR

SEQ ID NO: 2908 - protein, 9 aa, Homo sapiens
DGNTLTYYR

SEQ ID NO: 2909 - protein, 12 aa, Homo sapiens
DGQERDAPIVNK

SEQ ID NO: 2910 - protein, 22 aa, Homo sapiens
DGRPEIQLHNHWAQLTVGAGPR

SEQ ID NO: 2911 - protein, 20 aa, Homo sapiens
DGSPDVTTADIGANTPDATK

SEQ ID NO: 2912 - protein, 10 aa, Homo sapiens
DGSYAAWLSR

SEQ ID NO: 2913 - protein, 16 aa, Homo sapiens
DGTFPLPIGESVTVTR

SEQ ID NO: 2914 - protein, 9 aa, Homo sapiens
DGTVTTDWK

SEQ ID NO: 2915 - protein, 28 aa, Homo sapiens
DGWHSWPIAHQWPQGPSAVDAAFSWEEK

SEQ ID NO: 2916 - protein, 9 aa, Homo sapiens
DGYLFQLLR

SEQ ID NO: 2917 - protein, 6 aa, Homo sapiens
DGYVLR

SEQ ID NO: 2918 - protein, 9 aa, Homo sapiens
DHAVDLIQK

SEQ ID NO: 2919 - protein, 9 aa, Homo sapiens
DHENELLNK

SEQ ID NO: 2920 - protein, 7 aa, Homo sapiens
DHFGYTK

SEQ ID NO: 2921 - protein, 14 aa, Homo sapiens
DHLGFQVTWPDESK

SEQ ID NO: 2922 - protein, 10 aa, Homo sapiens
DHSAIPVINR

SEQ ID NO: 2923 - protein, 14 aa, Homo sapiens
DHSGQVFSVVSNGK

SEQ ID NO: 2924 - protein, 6 aa, Homo sapiens
DIALLK

SEQ ID NO: 2925 - protein, 6 aa, Homo sapiens
DIFISK

SEQ ID NO: 2926 - protein, 11 aa, Homo sapiens
DIFTGLIGPMK

SEQ ID NO: 2927 - protein, 10 aa, Homo sapiens
DINYVNPVIK

SEQ ID NO: 2928 - protein, 19 aa, Homo sapiens
DIPQPHAEPWAFSLDLGLK

SEQ ID NO: 2929 - protein, 19 aa, Homo sapiens
DIPTNSPELEETLTHTITK

SEQ ID NO: 2930 - protein, 18 aa, Homo sapiens
DIQMTQSPSSLSASVGDR

SEQ ID NO: 2931 - protein, 18 aa, Homo sapiens
DIQMTQSPSTLSASVGDR

SEQ ID NO: 2932 - protein, 9 aa, Homo sapiens
DISEVVTPR

SEQ ID NO: 2933 - protein, 18 aa, Homo sapiens
DIVMTQSPDSLAVSLGER

SEQ ID NO: 2934 - protein, 9 aa, Homo sapiens
DIYKGVDMR

SEQ ID NO: 2935 - protein, 20 aa, Homo sapiens
DKDWVWEHFSSMEKEDQSLK

SEQ ID NO: 2936 - protein, 10 aa, Homo sapiens
DKHADPDFTR

SEQ ID NO: 2937 - protein, 11 aa, Homo sapiens
DKHADPDFTRK

SEQ ID NO: 2938 - protein, 13 aa, Homo sapiens
DKTQYIFNNMVLK

SEQ ID NO: 2939 - protein, 11 aa, Homo sapiens
DKVNSFFSTFK

SEQ ID NO: 2940 - protein, 13 aa, Homo sapiens
DKVNSFFSTFKEK

SEQ ID NO: 2941 - protein, 18 aa, Homo sapiens
DKVNSFFSTFKEKESQDK

SEQ ID NO: 2942 - protein, 7 aa, Homo sapiens
DKVTAWK

SEQ ID NO: 2943 - protein, 11 aa, Homo sapiens
DKVWVYPPEKK

SEQ ID NO: 2944 - protein, 7 aa, Homo sapiens
DLASIAR

SEQ ID NO: 2945 - protein, 17 aa, Homo sapiens
DLDSQTMMVLVNYIFFK

SEQ ID NO: 2946 - protein, 18 aa, Homo sapiens
DLEIEVVLFHPNYNINGK

SEQ ID NO: 2947 - protein, 19 aa, Homo sapiens
DLEIEVVLFHPNYNINGKK

SEQ ID NO: 2948 - protein, 7 aa, Homo sapiens
DLGPLTK

SEQ ID NO: 2949 - protein, 14 aa, Homo sapiens
DLHFLEELQLGHNR

SEQ ID NO: 2950 - protein, 11 aa, Homo sapiens
DLKVEDIPLAR

SEQ ID NO: 2951 - protein, 10 aa, Homo sapiens
DLLLPQPDLR

SEQ ID NO: 2952 - protein, 9 aa, Homo sapiens
DLLYIGKDR

SEQ ID NO: 2953 - protein, 13 aa, Homo sapiens
DLQFSEIRETSAK

SEQ ID NO: 2954 - protein, 14 aa, Homo sapiens
DLRDKVNSFFSTFK

SEQ ID NO: 2955 - protein, 16 aa, Homo sapiens
DLRDKVNSFFSTFKEK

SEQ ID NO: 2956 - protein, 21 aa, Homo sapiens
DLRDKVNSFFSTFKEKESQDK

SEQ ID NO: 2957 - protein, 7 aa, Homo sapiens
DLSGGLK

SEQ ID NO: 2958 - protein, 9 aa, Homo sapiens
DLSGITGAR

SEQ ID NO: 2959 - protein, 8 aa, Homo sapiens
DLSLREGK

SEQ ID NO: 2960 - protein, 11 aa, Homo sapiens
DLTALSNMLPK

SEQ ID NO: 2961 - protein, 13 aa, Homo sapiens
DMPASEDLQDLQK

SEQ ID NO: 2962 - protein, 14 aa, Homo sapiens
DMPASEDLQDLQKK

SEQ ID NO: 2963 - protein, 8 aa, Homo sapiens
DMVEYKDR

SEQ ID NO: 2964 - protein, 10 aa, Homo sapiens
DNELLVYKER

SEQ ID NO: 2965 - protein, 8 aa, Homo sapiens
DNEQHVFK

SEQ ID NO: 2966 - protein, 10 aa, Homo sapiens
DNEQHVFKVK

SEQ ID NO: 2967 - protein, 21 aa, Homo sapiens
DNFHGLAIFLDTYPNDETTER

SEQ ID NO: 2968 - protein, 17 aa, Homo sapiens
DNLQHKDSSVPNTGTAR

SEQ ID NO: 2969 - protein, 11 aa, Homo sapiens
DNQRPSGVPDR

SEQ ID NO: 2970 - protein, 15 aa, Homo sapiens
DNSKNTLYLQMNSLR

SEQ ID NO: 2971 - protein, 10 aa, Homo sapiens
DNTNEIYSGK

SEQ ID NO: 2972 - protein, 30 aa, Homo sapiens; identical to SEQ ID NO: 647

SEQ ID NO: 2973 - protein, 11 aa, Homo sapiens
DPNGLPPEAQK

SEQ ID NO: 2974 - protein, 12 aa, Homo sapiens
DPTFIPAPIQAK

SEQ ID NO: 2975 - protein, 31 aa, Homo sapiens
DQFNLIVFSTEATQWRPSLVPASAENVNKAR

SEQ ID NO: 2976 - protein, 10 aa, Homo sapiens
DQNVEELKGR

SEQ ID NO: 2977 - protein, 20 aa, Homo sapiens
DQTIRFDHVITNMNNNYEPR

SEQ ID NO: 2978 - protein, 18 aa, Homo sapiens
DQTVSDNELQEMSNQGSK

SEQ ID NO: 2979 - protein, 11 aa, Homo sapiens
DRDGNTLTYYR

SEQ ID NO: 2980 - protein, 9 aa, Homo sapiens
DRFTEDAKR

SEQ ID NO: 2981 - protein, 9 aa, Homo sapiens
DSEITFIKK

SEQ ID NO: 2982 - protein, 17 aa, Homo sapiens
DSEKLKEEIGKELEELR

SEQ ID NO: 2983 - protein, 19 aa, Homo sapiens
DSEKLKEEIGKELEELRAR

SEQ ID NO: 2984 - protein, 15 aa, Homo sapiens
DSFHLDEQFTVPVEM

SEQ ID NO: 2985 - protein, 19 aa, Homo sapiens
DSFHLDEQFTVPVEMMQAR

SEQ ID NO: 2986 - protein, 15 aa, Homo sapiens
DSGEGDFLAEGGGVR

SEQ ID NO: 2987 - protein, 10 aa, Homo sapiens
DSGFQMNQLR

SEQ ID NO: 2988 - protein, 17 aa, Homo sapiens
DSGRDYVSQFEGSALGK

SEQ ID NO: 2989 - protein, 20 aa, Homo sapiens
DSGVPDRFSGSGSGTDFTLK

SEQ ID NO: 2990 - protein, 13 aa, Homo sapiens
DSGVTVNGELIGA

SEQ ID NO: 2991 - protein, 13 aa, Homo sapiens
DSLDKEKEKHIDR

SEQ ID NO: 2992 - protein, 35 aa, Homo sapiens
DSLDKEKEKHIDREFVVMFSVVDENFSWYLEDNIK

SEQ ID NO: 2993 - protein, 32 aa, Homo sapiens; identical to SEQ ID NO: 1818

SEQ ID NO: 2994 - protein, 36 aa, Homo sapiens
DSLDQLVGGVPVTLNAQTIDVNQETSDLDPSKSVTR

SEQ ID NO: 2995 - protein, 6 aa, Homo sapiens
DSLEFR

SEQ ID NO: 2996 - protein, 15 aa, Homo sapiens
DSLEFREIGELYLPK

SEQ ID NO: 2997 - protein, 14 aa, Homo sapiens
DSLLQDGEFSMDLR

SEQ ID NO: 2998 - protein, 14 aa, Homo sapiens
DSPVLIDFFEDTER

SEQ ID NO: 2999 - protein, 16 aa, Homo sapiens
DSPVLIDFFEDTERYR

SEQ ID NO: 3000 - protein, 16 aa, Homo sapiens
DSQEEEKTEALTSAKR

SEQ ID NO: 3001 - protein, 12 aa, Homo sapiens
DSSTWLTAFVLK

SEQ ID NO: 3002 - protein, 11 aa, Homo sapiens
DSSVPNTGTAR

SEQ ID NO: 3003 - protein, 7 aa, Homo sapiens
DSVSLRK

SEQ ID NO: 3004 - protein, 19 aa, Homo sapiens
DSWLDKQAEISASAPTSLR

SEQ ID NO: 3005 - protein, 12 aa, Homo sapiens
DSYVGDEAQSKR

SEQ ID NO: 3006 - protein, 18 aa, Homo sapiens
DSYYMTSSQLSTPLQQWR

SEQ ID NO: 3007 - protein, 33 aa, Homo sapiens; identical to SEQ ID NO: 611

SEQ ID NO: 3008 - protein, 12 aa, Homo sapiens
DTDTGALLFIGK

SEQ ID NO: 3009 - protein, 7 aa, Homo sapiens
DTEDKLR

SEQ ID NO: 3010 - protein, 12 aa, Homo sapiens
DTEDQEDQVDPR

SEQ ID NO: 3011 - protein, 7 aa, Homo sapiens
DTLMISR

SEQ ID NO: 3012 - protein, 12 aa, Homo sapiens
DTMVEDLVVLVR

SEQ ID NO: 3013 - protein, 11 aa, Homo sapiens
DTQDIEASHYR

SEQ ID NO: 3014 - protein, 14 aa, Homo sapiens
DVFLEMNIPYSVVR

SEQ ID NO: 3015 - protein, 13 aa, Homo sapiens
DVGKVVDSDRPER

SEQ ID NO: 3016 - protein, 13 aa, Homo sapiens
DVINEAWFPEDQR

SEQ ID NO: 3017 - protein, 21 aa, Homo sapiens
DVSSALDKLKEFGNTLEDKAR

SEQ ID NO: 3018 - protein, 15 aa, Homo sapiens
DVWGIEGPIDAAFTR

SEQ ID NO: 3019 - protein, 16 aa, Homo sapiens
DWHGVPGQVDAAMAGR

SEQ ID NO: 3020 - protein, 23 aa, Homo sapiens
DYIEFNKEIPAWVPFDPAAQITK

SEQ ID NO: 3021 - protein, 10 aa, Homo sapiens
DYIFGNYIER

SEQ ID NO: 3022 - protein, 20 aa, Homo sapiens
DYNLNDILLQLGIEEAFTSK

SEQ ID NO: 3023 - protein, 30 aa, Homo sapiens
DYNLNDILLQLGIEEAFTSKADLSGITGAR

SEQ ID NO: 3024 - protein, 7 aa, Homo sapiens
DYWSTVK

SEQ ID NO: 3025 - protein, 8 aa, Homo sapiens
EAFAAVSK

SEQ ID NO: 3026 - protein, 12 aa, Homo sapiens
EAGDHPVELLAR

SEQ ID NO: 3027 - protein, 16 aa, Homo sapiens
EAGIPEFYDYDVALIK

SEQ ID NO: 3028 - protein, 15 aa, Homo sapiens
EALIQFLEQVHQGIK

SEQ ID NO: 3029 - protein, 15 aa, Homo sapiens
EALKESQLPTVMDFR

SEQ ID NO: 3030 - protein, 6 aa, Homo sapiens
EALQIK

SEQ ID NO: 3031 - protein, 12 aa, Homo sapiens
EALVKGNPPIYR

SEQ ID NO: 3032 - protein, 12 aa, Homo sapiens
EAPKVVEEQESR

SEQ ID NO: 3033 - protein, 10 aa, Homo sapiens
EAQLPVIENK

SEQ ID NO: 3034 - protein, 13 aa, Homo sapiens
EAQQYSEALASTR

SEQ ID NO: 3035 - protein, 14 aa, Homo sapiens
EATIPGHLNSYTIK

SEQ ID NO: 3036 - protein, 8 aa, Homo sapiens
EAVEHLQK

SEQ ID NO: 3037 - protein, 22 aa, Homo sapiens
EAVEHLQKSELTQQLNALFQDK

SEQ ID NO: 3038 - protein, 35 aa, Homo sapiens; identical to SEQ ID NO: 1512

SEQ ID NO: 3039 - protein, 15 aa, Homo sapiens
EAVEKEFEPLLNWMK

SEQ ID NO: 3040 - protein, 23 aa, Homo sapiens
EAVMDINKPGPLFKPENGLLETK

SEQ ID NO: 3041 - protein, 6 aa, Homo sapiens
EAVSGR

SEQ ID NO: 3042 - protein, 8 aa, Homo sapiens
EAVVAKPK

SEQ ID NO: 3043 - protein, 8 aa, Homo sapiens
EDRVPHSR

SEQ ID NO: 3044 - protein, 19 aa, Homo sapiens
EEEHLGILGPQLHADVGDK

SEQ ID NO: 3045 - protein, 21 aa, Homo sapiens
EEEHLGILGPQLHADVGDKVK

SEQ ID NO: 3046 - protein, 12 aa, Homo sapiens
EEFWLGLDNLNK

SEQ ID NO: 3047 - protein, 28 aa, Homo sapiens
EEKAGELEVFNGYFVHFFAPDNLDPIPK

SEQ ID NO: 3048 - protein, 6 aa, Homo sapiens
EELAAK

SEQ ID NO: 3049 - protein, 10 aa, Homo sapiens
EELLPAQDIK

SEQ ID NO: 3050 - protein, 11 aa, Homo sapiens
EENLTQENQDR

SEQ ID NO: 3051 - protein, 10 aa, Homo sapiens
EEPHTETVRK

SEQ ID NO: 3052 - protein, 10 aa, Homo sapiens
EEYSNLKLPR

SEQ ID NO: 3053 - protein, 9 aa, Homo sapiens
EFDHNSNIR

SEQ ID NO: 3054 - protein, 9 aa, Homo sapiens
EFGNTLEDK

SEQ ID NO: 3055 - protein, 7 aa, Homo sapiens
EFHLHLR

SEQ ID NO: 3056 - protein, 8 aa, Homo sapiens
EFMSQGNK

SEQ ID NO: 3057 - protein, 13 aa, Homo sapiens
EFPYRIPLDLVPK

SEQ ID NO: 3058 - protein, 7 aa, Homo sapiens
EFQEGLK

SEQ ID NO: 3059 - protein, 7 aa, Homo sapiens
EFSHLGK

SEQ ID NO: 3060 - protein, 18 aa, Homo sapiens
EGAIHREELVYELNPLDH

SEQ ID NO: 3061 - protein, 19 aa, Homo sapiens
EGAIHREELVYELNPLDHR

SEQ ID NO: 3062 - protein, 20 aa, Homo sapiens
EGAIHREELVYELNPLDHRG

SEQ ID NO: 3063 - protein, 20 aa, Homo sapiens
EGAMSAQLGYPVVGWHIANK

SEQ ID NO: 3064 - protein, 12 aa, Homo sapiens
EGDFLAEGGGVR

SEQ ID NO: 3065 - protein, 16 aa, Homo sapiens
EGGPSQIGDALGFAVR

SEQ ID NO: 3066 - protein, 11 aa, Homo sapiens
EGGQTAPASTR

SEQ ID NO: 3067 - protein, 16 aa, Homo sapiens
EGKEYGVVLAPDGSTV

SEQ ID NO: 3068 - protein, 32 aa, Homo sapiens; identical to SEQ ID NO: 471

SEQ ID NO: 3069 - protein, 19 aa, Homo sapiens
EGKQVGSGVTTDQVQAEAK

SEQ ID NO: 3070 - protein, 27 aa, Homo sapiens
EGKQVGSGVTTDQVQAEAKESGPTTYK

SEQ ID NO: 3071 - protein, 10 aa, Homo sapiens
EGMLSIMSYR

SEQ ID NO: 3072 - protein, 11 aa, Homo sapiens
EGQAVAVPSSK

SEQ ID NO: 3073 - protein, 14 aa, Homo sapiens
EGQMESVEAAMSSK

SEQ ID NO: 3074 - protein, 28 aa, Homo sapiens
EGSQPPPASGYWVYSPIRSGLHKLFPSR

SEQ ID NO: 3075 - protein, 25 aa, Homo sapiens
EGVQKEDIPPADLSDQVPDTESETR

SEQ ID NO: 3076 - protein, 21 aa, Homo sapiens
EHGDPLIEELNPGDALEPEGR

SEQ ID NO: 3077 - protein, 15 aa, Homo sapiens
EHLVQATPENLQEAR

SEQ ID NO: 3078 - protein, 9 aa, Homo sapiens
EHSSLAFWK

SEQ ID NO: 3079 - protein, 13 aa, Homo sapiens
EIEEVLTPEMLMR

SEQ ID NO: 3080 - protein, 10 aa, Homo sapiens
EIFRWPESPK

SEQ ID NO: 3081 - protein, 9 aa, Homo sapiens
EIGELYLPK

SEQ ID NO: 3082 - protein, 9 aa, Homo sapiens
EIIIHQNYK

SEQ ID NO: 3083 - protein, 8 aa, Homo sapiens
EIIKPAEK

SEQ ID NO: 3084 - protein, 11 aa, Homo sapiens
EIMENYNIALR

SEQ ID NO: 3085 - protein, 16 aa, Homo sapiens
EIPAWVPFDPAAQITK

SEQ ID NO: 3086 - protein, 17 aa, Homo sapiens
EIPDEISILLLGVAHFK

SEQ ID NO: 3087 - protein, 7 aa, Homo sapiens
EIQIYKK

SEQ ID NO: 3088 - protein, 10 aa, Homo sapiens
EIQNAVNGVK

SEQ ID NO: 3089 - protein, 11 aa, Homo sapiens
EITALAPSTMK

SEQ ID NO: 3090 - protein, 6 aa, Homo sapiens
EIVLPK

SEQ ID NO: 3091 - protein, 18 aa, Homo sapiens
EIVLTQSPATLSLSPGER

SEQ ID NO: 3092 - protein, 18 aa, Homo sapiens
EIVLTQSPGTLSLSPGER

SEQ ID NO: 3093 - protein, 10 aa, Homo sapiens
EIVNKHNELR

SEQ ID NO: 3094 - protein, 11 aa, Homo sapiens
EIVNKHNELRR

SEQ ID NO: 3095 - protein, 13 aa, Homo sapiens
EKAGFSWIEVTFK

SEQ ID NO: 3096 - protein, 18 aa, Homo sapiens
EKDPQPQQLPPMDPKLLK

SEQ ID NO: 3097 - protein, 24 aa, Homo sapiens
EKFSDASYQSINIPVTQNMVPSSR

SEQ ID NO: 3098 - protein, 11 aa, Homo sapiens
EKGEIQNILQK

SEQ ID NO: 3099 - protein, 11 aa, Homo sapiens
EKLQDEDLGFL

SEQ ID NO: 3100 - protein, 24 aa, Homo sapiens
EKPQSTISGLLGPTLYAEVGDIIK

SEQ ID NO: 3101 - protein, 14 aa, Homo sapiens
EKPVWLGFLGPIIK

SEQ ID NO: 3102 - protein, 11 aa, Homo sapiens
ELDESLQVAER

SEQ ID NO: 3103 - protein, 17 aa, Homo sapiens
ELDRDTVFALVNYIFFK

SEQ ID NO: 3104 - protein, 11 aa, Homo sapiens
ELDVAAEKIDR

SEQ ID NO: 3105 - protein, 7 aa, Homo sapiens
ELENALK

SEQ ID NO: 3106 - protein, 15 aa, Homo sapiens
ELGGHLDQQVEEFRR

SEQ ID NO: 3107 - protein, 6 aa, Homo sapiens
ELISER

SEQ ID NO: 3108 - protein, 18 aa, Homo sapiens
ELKEQQDSPGNKDFLQSL

SEQ ID NO: 3109 - protein, 19 aa, Homo sapiens
ELKEQQDSPGNKDFLQSLK

SEQ ID NO: 3110 - protein, 10 aa, Homo sapiens
ELLALIQLER

SEQ ID NO: 3111 - protein, 11 aa, Homo sapiens
ELLDTVTAPQK

SEQ ID NO: 3112 - protein, 10 aa, Homo sapiens
ELLESYIDGR

SEQ ID NO: 3113 - protein, 6 aa, Homo sapiens
ELLVPR

SEQ ID NO: 3114 - protein, 20 aa, Homo sapiens
ELNQAGQETLVTGWGYHSSR

SEQ ID NO: 3115 - protein, 8 aa, Homo sapiens
ELPEHTVK

SEQ ID NO: 3116 - protein, 6 aa, Homo sapiens
ELPTLK

SEQ ID NO: 3117 - protein, 13 aa, Homo sapiens
ELQETNAALQDVR

SEQ ID NO: 3118 - protein, 14 aa, Homo sapiens
ELQQRLEPYADQLR

SEQ ID NO: 3119 - protein, 8 aa, Homo sapiens
ELSDIAHR

SEQ ID NO: 3120 - protein, 14 aa, Homo sapiens
ELSEALGQIFDSQR

SEQ ID NO: 3121 - protein, 15 aa, Homo sapiens
ELSHLPSLYDYSAYR

SEQ ID NO: 3122 - protein, 16 aa, Homo sapiens
ELSHLPSLYDYSAYRR

SEQ ID NO: 3123 - protein, 25 aa, Homo sapiens
ELTPEVLQEWLDELEEMMLVVHMPR

SEQ ID NO: 3124 - protein, 8 aa, Homo sapiens
ELVLAGNR

SEQ ID NO: 3125 - protein, 10 aa, Homo sapiens
EMEDTLNHLK

SEQ ID NO: 3126 - protein, 13 aa, Homo sapiens
EMPFDPQDTHQSR

SEQ ID NO: 3127 - protein, 13 aa, Homo sapiens
EMSGSPASGIPVK

SEQ ID NO: 3128 - protein, 18 aa, Homo sapiens
ENADSLQASLRPHADELK

SEQ ID NO: 3129 - protein, 20 aa, Homo sapiens
ENADSLQASLRPHADELKAK

SEQ ID NO: 3130 - protein, 11 aa, Homo sapiens
ENLDRDIALMK

SEQ ID NO: 3131 - protein, 16 aa, Homo sapiens
ENQLEVLEVSWLHGLK

SEQ ID NO: 3132 - protein, 16 aa, Homo sapiens
ENSLYLTAFTVIGIRK

SEQ ID NO: 3133 - protein, 9 aa, Homo sapiens
ENSQYQPIK

SEQ ID NO: 3134 - protein, 18 aa, Homo sapiens
EPAHLMSLFGGKPMIIYK

SEQ ID NO: 3135 - protein, 17 aa, Homo sapiens
EPAVGEPAEVTTTVLVR

SEQ ID NO: 3136 - protein, 19 aa, Homo sapiens
EPLDDYVNTQGASLFSVTK

SEQ ID NO: 3137 - protein, 16 aa, Homo sapiens
EPQDTYHYLPFSLPHR

SEQ ID NO: 3138 - protein, 20 aa, Homo sapiens
EPRPSLSHLLSQYYGAGVAR

SEQ ID NO: 3139 - protein, 23 aa, Homo sapiens
EPTMYGEILSPNYPQAYPSEVEK

SEQ ID NO: 3140 - protein, 15 aa, Homo sapiens
EPTMYVGSTSVQTSR

SEQ ID NO: 3141 - protein, 16 aa, Homo sapiens
EQLQDMGLVDLFSPEK

SEQ ID NO: 3142 - protein, 8 aa, Homo sapiens
EQLSLLDR

SEQ ID NO: 3143 - protein, 14 aa, Homo sapiens
EQLSLLDRFTEDAK

SEQ ID NO: 3144 - protein, 15 aa, Homo sapiens
EQLSLLDRFTEDAKR

SEQ ID NO: 3145 - protein, 8 aa, Homo sapiens
EQPGVYTK

SEQ ID NO: 3146 - protein, 8 aa, Homo sapiens
EQPPSLTR

SEQ ID NO: 3147 - protein, 16 aa, Homo sapiens
EQQDSPGNKDFLQSLK

SEQ ID NO: 3148 - protein, 12 aa, Homo sapiens
ERGHMLENHVER

SEQ ID NO: 3149 - protein, 25 aa, Homo sapiens
ERGPEEEHLGILGPVIWAEVGDTIR

SEQ ID NO: 3150 - protein, 19 aa, Homo sapiens
ERPGVYTNVVEYVDWILEK

SEQ ID NO: 3151 - protein, 7 aa, Homo sapiens
ERVYFFK

SEQ ID NO: 3152 - protein, 9 aa, Homo sapiens
ESASLMVDR

SEQ ID NO: 3153 - protein, 10 aa, Homo sapiens
ESDTSYVSLK

SEQ ID NO: 3154 - protein, 8 aa, Homo sapiens
ESGPTTYK

SEQ ID NO: 3155 - protein, 12 aa, Homo sapiens
ESKPLTAQQTTK

SEQ ID NO: 3156 - protein, 13 aa, Homo sapiens
ESLLNHFLYEVAR

SEQ ID NO: 3157 - protein, 11 aa, Homo sapiens
ESLQQMAEVTR

SEQ ID NO: 3158 - protein, 15 aa, Homo sapiens
ESLSPEFLRPVPQLR

SEQ ID NO: 3159 - protein, 27 aa, Homo sapiens
ESPGNVQIVNGYFVHFFAPQGLPVVPK

SEQ ID NO: 3160 - protein, 35 aa, Homo sapiens
ESQDKTLSLPELEQQQEQQQEQQQEQVQMLAPLES

SEQ ID NO: 3161 - protein, 16 aa, Homo sapiens
ESSSHHPGIAEFPSRG

SEQ ID NO: 3162 - protein, 11 aa, Homo sapiens
ESYSGVTLDPR

SEQ ID NO: 3163 - protein, 19 aa, Homo sapiens
ETAVDGELVVLYDVKREEK

SEQ ID NO: 3164 - protein, 11 aa, Homo sapiens
ETGDKVYVHLK

SEQ ID NO: 3165 - protein, 8 aa, Homo sapiens
ETLLQDFR

SEQ ID NO: 3166 - protein, 12 aa, Homo sapiens
ETLQKLPEEIQR

SEQ ID NO: 3167 - protein, 11 aa, Homo sapiens
ETSNFGFSLLR

SEQ ID NO: 3168 - protein, 12 aa, Homo sapiens
ETSNFGFSLLRK

SEQ ID NO: 3169 - protein, 10 aa, Homo sapiens
ETTLGDMTGK

SEQ ID NO: 3170 - protein, 14 aa, Homo sapiens
ETTWDYASDHGEKK

SEQ ID NO: 3171 - protein, 32 aa, Homo sapiens
ETVLTFIDPEGSEVDMVEEIDHIGIISFPDFK

SEQ ID NO: 3172 - protein, 11 aa, Homo sapiens
ETYDFDIAVLR

SEQ ID NO: 3173 - protein, 10 aa, Homo sapiens
EVFGQFNGKR

SEQ ID NO: 3174 - protein, 27 aa, Homo sapiens
EVKVEKPTADAEAYVFTPNMICAGGEK

SEQ ID NO: 3175 - protein, 12 aa, Homo sapiens
EVLKSLNEEAVK

SEQ ID NO: 3176 - protein, 13 aa, Homo sapiens
EVLKSLNEEAVKK

SEQ ID NO: 3177 - protein, 6 aa, Homo sapiens
EVLLPK

SEQ ID NO: 3178 - protein, 12 aa, Homo sapiens
EVPLNTIIFMGR

SEQ ID NO: 3179 - protein, 15 aa, Homo sapiens
EVQGFESATFLGYFK

SEQ ID NO: 3180 - protein, 19 aa, Homo sapiens
EVQLLESGGGLVQPGGSLR

SEQ ID NO: 3181 - protein, 12 aa, Homo sapiens
EVQLVAHSPWLK

SEQ ID NO: 3182 - protein, 17 aa, Homo sapiens
EVQLVAHSPWLKDSLSR

SEQ ID NO: 3183 - protein, 19 aa, Homo sapiens
EVQLVESGGGLVQPGGSLR

SEQ ID NO: 3184 - protein, 13 aa, Homo sapiens
EVQVFEITENSAK

SEQ ID NO: 3185 - protein, 23 aa, Homo sapiens
EVSADQVATVMWDYFSQLSNNAK

SEQ ID NO: 3186 - protein, 10 aa, Homo sapiens
EVSFDVELPK

SEQ ID NO: 3187 - protein, 25 aa, Homo sapiens
EVYMPSSIFQDDFVIPDISEPGTWK

SEQ ID NO: 3188 - protein, 12 aa, Homo sapiens
EWFWDLATGTMK

SEQ ID NO: 3189 - protein, 14 aa, Homo sapiens
EWFWDLATGTMKER

SEQ ID NO: 3190 - protein, 15 aa, Homo sapiens
EWVAIESDSVQPVPR

SEQ ID NO: 3191 - protein, 27 aa, Homo sapiens
EYANQFMWEYSTNYGQAPLSLLVSYTK

SEQ ID NO: 3192 - protein, 17 aa, Homo sapiens
EYSGTIASEANTYLNSK

SEQ ID NO: 3193 - protein, 10 aa, Homo sapiens
EYTDASFTNR

SEQ ID NO: 3194 - protein, 11 aa, Homo sapiens
EYTDASFTNRK

SEQ ID NO: 3195 - protein, 21 aa, Homo sapiens
EYVLPHFSVSIEPEYNFIGYK

SEQ ID NO: 3196 - protein, 20 aa, Homo sapiens
EYYFAEAQIADFSDPAFISK

SEQ ID NO: 3197 - protein, 7 aa, Homo sapiens
FAFNLYR

SEQ ID NO: 3198 - protein, 9 aa, Homo sapiens
FAGVFHVEK

SEQ ID NO: 3199 - protein, 9 aa, Homo sapiens
FAHNVVTMR

SEQ ID NO: 3200 - protein, 18 aa, Homo sapiens
FAHYVVTSQVVNTANEAR

SEQ ID NO: 3201 - protein, 26 aa, Homo sapiens
FAIQTDPNSNDGLVTVVKPIDFETNR

SEQ ID NO: 3202 - protein, 10 aa, Homo sapiens
FASTFDKNFR

SEQ ID NO: 3203 - protein, 14 aa, Homo sapiens
FAVLQENVAWGNGR

SEQ ID NO: 3204 - protein, 26 aa, Homo sapiens
FDAATLHTSTAMAAQHGMDDDGTGQK

SEQ ID NO: 3205 - protein, 11 aa, Homo sapiens
FDGILGMAYPR

SEQ ID NO: 3206 - protein, 15 aa, Homo sapiens
FDHVITNMNNNYEPR

SEQ ID NO: 3207 - protein, 14 aa, Homo sapiens
FDKNGNMAGISDQR

SEQ ID NO: 3208 - protein, 10 aa, Homo sapiens
FDPQDTHQSR

SEQ ID NO: 3209 - protein, 11 aa, Homo sapiens
FDPVRGEVPPR

SEQ ID NO: 3210 - protein, 12 aa, Homo sapiens
FEDGVLDPDYPR

SEQ ID NO: 3211 - protein, 13 aa, Homo sapiens
FEGHFDGVPVISK

SEQ ID NO: 3212 - protein, 9 aa, Homo sapiens
FELHYQEVK

SEQ ID NO: 3213 - protein, 7 aa, Homo sapiens
FFGEGTK

SEQ ID NO: 3214 - protein, 8 aa, Homo sapiens
FFGEGTKK

SEQ ID NO: 3215 - protein, 10 aa, Homo sapiens
FFHGQALTNK

SEQ ID NO: 3216 - protein, 10 aa, Homo sapiens
FFHKNEIWYR

SEQ ID NO: 3217 - protein, 17 aa, Homo sapiens
FFHPEEWADLFQAAGAK

SEQ ID NO: 3218 - protein, 8 aa, Homo sapiens
FFSAQTNR

SEQ ID NO: 3219 - protein, 15 aa, Homo sapiens
FFTREPQDTYHYLPF

SEQ ID NO: 3220 - protein, 19 aa, Homo sapiens
FFTREPQDTYHYLPFSLPH

SEQ ID NO: 3221 - protein, 20 aa, Homo sapiens
FFTREPQDTYHYLPFSLPHR

SEQ ID NO: 3222 - protein, 25 aa, Homo sapiens
FGGVLHLSDLDDDGLDEIIMAAPLR

SEQ ID NO: 3223 - protein, 8 aa, Homo sapiens
FGHGDKVR

SEQ ID NO: 3224 - protein, 10 aa, Homo sapiens
FGLLDEDGKK

SEQ ID NO: 3225 - protein, 14 aa, Homo sapiens
FGLLDEDGKKTFFR

SEQ ID NO: 3226 - protein, 33 aa, Homo sapiens
FGSALAVLDFNVDGVPDLAVGAPSVGSEQLTYK

SEQ ID NO: 3227 - protein, 9 aa, Homo sapiens
FGSSLITVR

SEQ ID NO: 3228 - protein, 9 aa, Homo sapiens
FHGHSFQYK

SEQ ID NO: 3229 - protein, 9 aa, Homo sapiens
FHKNEIWYR

SEQ ID NO: 3230 - protein, 8 aa, Homo sapiens
FIADVATK

SEQ ID NO: 3231 - protein, 28 aa, Homo sapiens
FIEDNIEYITIIAFAQYVQEATFEEMEK

SEQ ID NO: 3232 - protein, 31 aa, Homo sapiens; identical to SEQ ID NO: 890

SEQ ID NO: 3233 - protein, 29 aa, Homo sapiens
FINDYGTHYITSGSMGGIYEYILVIDKAK

SEQ ID NO: 3234 - protein, 14 aa, Homo sapiens
FIWYNNVINPTLPR

SEQ ID NO: 3235 - protein, 9 aa, Homo sapiens
FKDLGEENF

SEQ ID NO: 3236 - protein, 10 aa, Homo sapiens
FKDLGEENFK

SEQ ID NO: 3237 - protein, 10 aa, Homo sapiens
FKIETTPESR

SEQ ID NO: 3238 - protein, 9 aa, Homo sapiens
FKKPQSLTK

SEQ ID NO: 3239 - protein, 20 aa, Homo sapiens
FKLDDDLEHQGGHVLDHGHK

SEQ ID NO: 3240 - protein, 21 aa, Homo sapiens
FKLDDDLEHQGGHVLDHGHKH

SEQ ID NO: 3241 - protein, 22 aa, Homo sapiens
FKLDDDLEHQGGHVLDHGHKHK

SEQ ID NO: 3242 - protein, 14 aa, Homo sapiens
FKLDQKYEMHELLR

SEQ ID NO: 3243 - protein, 16 aa, Homo sapiens
FKNGMLHGDKVSFFCK

SEQ ID NO: 3244 - protein, 14 aa, Homo sapiens
FKQVEESHKQHLAR

SEQ ID NO: 3245 - protein, 18 aa, Homo sapiens
FKSGFPQVSMFFTHTFPK

SEQ ID NO: 3246 - protein, 8 aa, Homo sapiens
FKTGTTLK

SEQ ID NO: 3247 - protein, 17 aa, Homo sapiens
FLATTPNSLLVSWQPPR

SEQ ID NO: 3248 - protein, 12 aa, Homo sapiens
FLEQQNQVLQTK

SEQ ID NO: 3249 - protein, 15 aa, Homo sapiens
FLFDTKEEILMHLWR

SEQ ID NO: 3250 - protein, 14 aa, Homo sapiens
FLGDKVTSYGGELR

SEQ ID NO: 3251 - protein, 20 aa, Homo sapiens
FLHVPDTFEGHFDGVPVISK

SEQ ID NO: 3252 - protein, 24 aa, Homo sapiens
FLHVPDTFEGHFDGVPVISKGQQK

SEQ ID NO: 3253 - protein, 18 aa, Homo sapiens
FLLKAEPLAFTFSHDYKG

SEQ ID NO: 3254 - protein, 11 aa, Homo sapiens
FLLYGLHEGKR

SEQ ID NO: 3255 - protein, 8 aa, Homo sapiens
FLMKGPNK

SEQ ID NO: 3256 - protein, 6 aa, Homo sapiens
FLNDVK

SEQ ID NO: 3257 - protein, 8 aa, Homo sapiens
FLNVLSPR

SEQ ID NO: 3258 - protein, 6 aa, Homo sapiens
FLNWIK

SEQ ID NO: 3259 - protein, 8 aa, Homo sapiens
FLQEQGHR

SEQ ID NO: 3260 - protein, 29 aa, Homo sapiens
FLQEQGHRAEATTLHVAPQGTAMAVSTFR

SEQ ID NO: 3261 - protein, 26 aa, Homo sapiens
FLSSLTETIEGVDAEDGHGPGEQQKR

SEQ ID NO: 3262 - protein, 6 aa, Homo sapiens
FLTTAK

SEQ ID NO: 3263 - protein, 8 aa, Homo sapiens
FLTTAKDK

SEQ ID NO: 3264 - protein, 17 aa, Homo sapiens
FLVFDENESWYLDDNIK

SEQ ID NO: 3265 - protein, 12 aa, Homo sapiens
FLVGPDGIPIMR

SEQ ID NO: 3266 - protein, 7 aa, Homo sapiens
FLVNLVK

SEQ ID NO: 3267 - protein, 8 aa, Homo sapiens
FMETVAEK

SEQ ID NO: 3268 - protein, 18 aa, Homo sapiens
FMGVVSLGSPSGEVSHPR

SEQ ID NO: 3269 - protein, 9 aa, Homo sapiens
FMQAVTGWK

SEQ ID NO: 3270 - protein, 8 aa, Homo sapiens
FNALQYLR

SEQ ID NO: 3271 - protein, 18 aa, Homo sapiens
FNAVLTNPQGDYDTSTGK

SEQ ID NO: 3272 - protein, 24 aa, Homo sapiens
FNHLGHIFTFTPQNNEFQLQLSPK

SEQ ID NO: 3273 - protein, 13 aa, Homo sapiens
FNKNNEGTYYSPN

SEQ ID NO: 3274 - protein, 15 aa, Homo sapiens
FNKNNEGTYYSPNYN

SEQ ID NO: 3275 - protein, 18 aa, Homo sapiens
FNKNNEGTYYSPNYNPQS

SEQ ID NO: 3276 - protein, 19 aa, Homo sapiens
FNKNNEGTYYSPNYNPQSR

SEQ ID NO: 3277 - protein, 22 aa, Homo sapiens
FNQPFIIMIFDHFTWSSLFLAR

SEQ ID NO: 3278 - protein, 18 aa, Homo sapiens
FNRPFLMIIVPTDTQNIF

SEQ ID NO: 3279 - protein, 22 aa, Homo sapiens
FNRPFLMIIVPTDTQNIFFMSK

SEQ ID NO: 3280 - protein, 13 aa, Homo sapiens
FNTANDDNVTQVR

SEQ ID NO: 3281 - protein, 14 aa, Homo sapiens
FNWYVDGVEVHNAK

SEQ ID NO: 3282 - protein, 14 aa, Homo sapiens
FPESWLWEVHLVPR

SEQ ID NO: 3283 - protein, 13 aa, Homo sapiens
FPGTYQTLEMFPR

SEQ ID NO: 3284 - protein, 14 aa, Homo sapiens
FPQVSMFFTHTFPK

SEQ ID NO: 3285 - protein, 9 aa, Homo sapiens
FQASVATPR

SEQ ID NO: 3286 - protein, 24 aa, Homo sapiens
FQILTLWLPDSLTTWEIHGLSLSK

SEQ ID NO: 3287 - protein, 9 aa, Homo sapiens
FQMIPLDPK

SEQ ID NO: 3288 - protein, 12 aa, Homo sapiens
FQNSAILTIQPK

SEQ ID NO: 3289 - protein, 10 aa, Homo sapiens
FQPTLLTLPR

SEQ ID NO: 3290 - protein, 12 aa, Homo sapiens
FQSGQVLAALPR

SEQ ID NO: 3291 - protein, 9 aa, Homo sapiens
FQSVFTVTR

SEQ ID NO: 3292 - protein, 26 aa, Homo sapiens
FQVDNNNRLLLQQVSLPELPGEYSMK

SEQ ID NO: 3293 - protein, 8 aa, Homo sapiens
FQWVDGSR

SEQ ID NO: 3294 - protein, 8 aa, Homo sapiens
FRDIASPK

SEQ ID NO: 3295 - protein, 9 aa, Homo sapiens
FREFHLHLR

SEQ ID NO: 3296 - protein, 10 aa, Homo sapiens
FRIEDGFSLK

SEQ ID NO: 3297 - protein, 17 aa, Homo sapiens
FRKPYNVESYTPQTQGK

SEQ ID NO: 3298 - protein, 8 aa, Homo sapiens
FRLPEISR

SEQ ID NO: 3299 - protein, 8 aa, Homo sapiens
FRPDGLPK

SEQ ID NO: 3300 - protein, 7 aa, Homo sapiens
FRQELFR

SEQ ID NO: 3301 - protein, 26 aa, Homo sapiens
FRVVSMDENFHPLNELIPLVYIQDPK

SEQ ID NO: 3302 - protein, 8 aa, Homo sapiens
FSAEFDFR

SEQ ID NO: 3303 - protein, 13 aa, Homo sapiens
FSALEVDETYVPK

SEQ ID NO: 3304 - protein, 22 aa, Homo sapiens
FSDASYQSINIPVTQNMVPSSR

SEQ ID NO: 3305 - protein, 13 aa, Homo sapiens
FSEGTAGDSLSLH

SEQ ID NO: 3306 - protein, 16 aa, Homo sapiens
FSEWGNNAFFYYFEHR

SEQ ID NO: 3307 - protein, 10 aa, Homo sapiens
FSGDGKDFYR

SEQ ID NO: 3308 - protein, 19 aa, Homo sapiens
FSGIDEHGHLTIDTELEGR

SEQ ID NO: 3309 - protein, 13 aa, Homo sapiens
FSGSGSGTDFTLK

SEQ ID NO: 3310 - protein, 16 aa, Homo sapiens
FSGSGSGTDFTLTISR

SEQ ID NO: 3311 - protein, 9 aa, Homo sapiens
FSGSLLGGK

SEQ ID NO: 3312 - protein, 10 aa, Homo sapiens
FSGTWYAMAK

SEQ ID NO: 3313 - protein, 15 aa, Homo sapiens
FSISATYDLGATLLK

SEQ ID NO: 3314 - protein, 15 aa, Homo sapiens
FSISGSYVLDQILPR

SEQ ID NO: 3315 - protein, 16 aa, Homo sapiens
FSISIPVKSDIAPVAR

SEQ ID NO: 3316 - protein, 8 aa, Homo sapiens
FSMPSPVR

SEQ ID NO: 3317 - protein, 29 aa, Homo sapiens
FSSHVGGTLGQFYQEVLWGSPAASDDGRR

SEQ ID NO: 3318 - protein, 13 aa, Homo sapiens
FSSSSGYGGGSSR

SEQ ID NO: 3319 - protein, 25 aa, Homo sapiens
FSTPEFTILNTFHIPSFTIDFVEMK

SEQ ID NO: 3320 - protein, 18 aa, Homo sapiens
FSVPAGIVIPSFQALTAR

SEQ ID NO: 3321 - protein, 7 aa, Homo sapiens
FSVVYAK

SEQ ID NO: 3322 - protein, 15 aa, Homo sapiens
FSYSSGHVHLSSENK

SEQ ID NO: 3323 - protein, 27 aa, Homo sapiens
FSYSSGHVHLSSENKFQNSAILTIQPK

SEQ ID NO: 3324 - protein, 7 aa, Homo sapiens
FTEDAKR

SEQ ID NO: 3325 - protein, 16 aa, Homo sapiens
FTEGPPLHKDDVNGIR

SEQ ID NO: 3326 - protein, 7 aa, Homo sapiens
FTFEYSR

SEQ ID NO: 3327 - protein, 9 aa, Homo sapiens
FTGLIGPMK

SEQ ID NO: 3328 - protein, 18 aa, Homo sapiens
FTGSQPFGQGVEHATANK

SEQ ID NO: 3329 - protein, 9 aa, Homo sapiens
FTISRDDSK

SEQ ID NO: 3330 - protein, 9 aa, Homo sapiens
FTISRDNAK

SEQ ID NO: 3331 - protein, 14 aa, Homo sapiens
FTKETYDFDIAVLR

SEQ ID NO: 3332 - protein, 22 aa, Homo sapiens
FTLSSERDFALLSLQVPLKDAK

SEQ ID NO: 3333 - protein, 10 aa, Homo sapiens
FTNIGPDTMR

SEQ ID NO: 3334 - protein, 15 aa, Homo sapiens
FTVDRPFLFLIYEHR

SEQ ID NO: 3335 - protein, 12 aa, Homo sapiens
FVFGTTPEDILR

SEQ ID NO: 3336 - protein, 16 aa, Homo sapiens
FVTAVGTQGAISKETK

SEQ ID NO: 3337 - protein, 10 aa, Homo sapiens
FVTWIEGVMR

SEQ ID NO: 3338 - protein, 9 aa, Homo sapiens
FWKDNLQHK

SEQ ID NO: 3339 - protein, 20 aa, Homo sapiens
FWKDNLQHKDSSVPNTGTAR

SEQ ID NO: 3340 - protein, 8 aa, Homo sapiens
FWTSFFPK

SEQ ID NO: 3341 - protein, 11 aa, Homo sapiens
FYNQVSTPLLR

SEQ ID NO: 3342 - protein, 6 aa, Homo sapiens
FYTFLK

SEQ ID NO: 3343 - protein, 7 aa, Homo sapiens
FYVVMWK

SEQ ID NO: 3344 - protein, 20 aa, Homo sapiens
GAAANLELIFVGPQHAGNYR

SEQ ID NO: 3345 - protein, 15 aa, Homo sapiens
GAAPPKQEFLDIEDP

SEQ ID NO: 3346 - protein, 10 aa, Homo sapiens
GAHTLGHNSR

SEQ ID NO: 3347 - protein, 8 aa, Homo sapiens
GAKKPLER

SEQ ID NO: 3348 - protein, 13 aa, Homo sapiens
GALDTALYAAGSK

SEQ ID NO: 3349 - protein, 7 aa, Homo sapiens
GALHNYK

SEQ ID NO: 3350 - protein, 7 aa, Homo sapiens
GAQELIR

SEQ ID NO: 3351 - protein, 11 aa, Homo sapiens
GASQAGAPQGR

SEQ ID NO: 3352 - protein, 12 aa, Homo sapiens
GASSAGLGPVVR

SEQ ID NO: 3353 - protein, 20 aa, Homo sapiens
GATDNKGPVLAWINAVSAFR

SEQ ID NO: 3354 - protein, 15 aa, Homo sapiens
GATLALTQVTPQDER

SEQ ID NO: 3355 - protein, 14 aa, Homo sapiens
GATTSPGVYELSSR

SEQ ID NO: 3356 - protein, 16 aa, Homo sapiens
GATYNIIVEALKDQQR

SEQ ID NO: 3357 - protein, 13 aa, Homo sapiens
GAYPLSIEPIGVR

SEQ ID NO: 3358 - protein, 7 aa, Homo sapiens
GDAEAVK

SEQ ID NO: 3359 - protein, 19 aa, Homo sapiens
GDIVMTQSPDSLAVSLGER

SEQ ID NO: 3360 - protein, 10 aa, Homo sapiens
GDKLFGPDLK

SEQ ID NO: 3361 - protein, 11 aa, Homo sapiens
GDKVWVYPPEK

SEQ ID NO: 3362 - protein, 9 aa, Homo sapiens
GDKVYVHLK

SEQ ID NO: 3363 - protein, 19 aa, Homo sapiens
GDSFTHTPPLDPQELDILK

SEQ ID NO: 3364 - protein, 11 aa, Homo sapiens
GDSGGPLIVHK

SEQ ID NO: 3365 - protein, 12 aa, Homo sapiens
GDSGGPLIVHKR

SEQ ID NO: 3366 - protein, 30 aa, Homo sapiens
GDSVVWYLFSAGNEADVHGIYFSGNTYLWR

SEQ ID NO: 3367 - protein, 16 aa, Homo sapiens
GEAFTLKATVLNYLPK

SEQ ID NO: 3368 - protein, 12 aa, Homo sapiens
GEFVWKSHKWDR

SEQ ID NO: 3369 - protein, 8 aa, Homo sapiens
GEFYIGSK

SEQ ID NO: 3370 - protein, 9 aa, Homo sapiens
GEGTSAHLR

SEQ ID NO: 3371 - protein, 7 aa, Homo sapiens
GEIHLGR

SEQ ID NO: 3372 - protein, 9 aa, Homo sapiens
GEIQNILQK

SEQ ID NO: 3373 - protein, 9 aa, Homo sapiens
GEKELLVPR

SEQ ID NO: 3374 - protein, 12 aa, Homo sapiens
GEVDHYQLALGK

SEQ ID NO: 3375 - protein, 20 aa, Homo sapiens
GEVLPLPEANFPSFPLPHHK

SEQ ID NO: 3376 - protein, 15 aa, Homo sapiens
GEVQAMLGQSTEELR

SEQ ID NO: 3377 - protein, 17 aa, Homo sapiens
GEVQAMLGQSTEELRVR

SEQ ID NO: 3378 - protein, 17 aa, Homo sapiens
GEWPWQVTLHTTSPTQR

SEQ ID NO: 3379 - protein, 15 aa, Homo sapiens
GEYEEHLGILGPIIR

SEQ ID NO: 3380 - protein, 8 aa, Homo sapiens
GEYFWEKR

SEQ ID NO: 3381 - protein, 12 aa, Homo sapiens
GFEPTLEALFGK

SEQ ID NO: 3382 - protein, 11 aa, Homo sapiens
GFIEGHVVIPR

SEQ ID NO: 3383 - protein, 8 aa, Homo sapiens
GFLGPIIK

SEQ ID NO: 3384 - protein, 9 aa, Homo sapiens
GFLLLASLR

SEQ ID NO: 3385 - protein, 26 aa, Homo sapiens
GFPIKEDFLEQSEQLFGAKPVSLTGK

SEQ ID NO: 3386 - protein, 39 aa, Homo sapiens
GFPIKEDFLEQSEQLFGAKPVSLTGKQEDDLANINQWVK

SEQ ID NO: 3387 - protein, 14 aa, Homo sapiens
GFPRGDKLFGPDLK

SEQ ID NO: 3388 - protein, 19 aa, Homo sapiens
GFQHLLHTLNLPGHGLETR

SEQ ID NO: 3389 - protein, 16 aa, Homo sapiens
GFSLDEATNLNGGLLR

SEQ ID NO: 3390 - protein, 10 aa, Homo sapiens
GFSPKDVLVR

SEQ ID NO: 3391 - protein, 14 aa, Homo sapiens
GFSSGSAVVSGGSR

SEQ ID NO: 3392 - protein, 9 aa, Homo sapiens
GFVVAGPSR

SEQ ID NO: 3393 - protein, 15 aa, Homo sapiens
GFYFNKPTGYGSSSR

SEQ ID NO: 3394 - protein, 10 aa, Homo sapiens
GFYFSRPASR

SEQ ID NO: 3395 - protein, 8 aa, Homo sapiens
GFYTHVFR

SEQ ID NO: 3396 - protein, 14 aa, Homo sapiens
GGEGTGYFVDFSVR

SEQ ID NO: 3397 - protein, 18 aa, Homo sapiens
GGETAQSADPQWEQLNNK

SEQ ID NO: 3398 - protein, 22 aa, Homo sapiens
GGGAGFISGLSYLELDNPAGNK

SEQ ID NO: 3399 - protein, 23 aa, Homo sapiens
GGGAGFISGLSYLELDNPAGNKR

SEQ ID NO: 3400 - protein, 21 aa, Homo sapiens
GGGALLGDRWILTAAHTIYPK

SEQ ID NO: 3401 - protein, 21 aa, Homo sapiens
GGGALLGDRWILTAAHTLYPK

SEQ ID NO: 3402 - protein, 13 aa, Homo sapiens
GGHLDQQVEEFRR

SEQ ID NO: 3403 - protein, 13 aa, Homo sapiens
GGKHHLGLEEPKK

SEQ ID NO: 3404 - protein, 15 aa, Homo sapiens
GGKIEVQLKNEHTSK

SEQ ID NO: 3405 - protein, 9 aa, Homo sapiens
GGPFSDSYR

SEQ ID NO: 3406 - protein, 9 aa, Homo sapiens
GGPLIVHKR

SEQ ID NO: 3407 - protein, 14 aa, Homo sapiens
GGSASTWLTAFALR

SEQ ID NO: 3408 - protein, 16 aa, Homo sapiens
GGSIQQYIYKQEPVQK

SEQ ID NO: 3409 - protein, 21 aa, Homo sapiens
GGTLSTPQTGSENDALYEYLR

SEQ ID NO: 3410 - protein, 8 aa, Homo sapiens
GGVASGFK

SEQ ID NO: 3411 - protein, 19 aa, Homo sapiens
GGVASGFKHVVPNEVVVQR

SEQ ID NO: 3412 - protein, 15 aa, Homo sapiens
GGVNDNFQGVLQNVR

SEQ ID NO: 3413 - protein, 12 aa, Homo sapiens
GHEHSIQFAEMK

SEQ ID NO: 3414 - protein, 21 aa, Homo sapiens
GHGATNDLTFTEEVDMKEMEK

SEQ ID NO: 3415 - protein, 18 aa, Homo sapiens
GHGLGHGHEQQHGLGHGH

SEQ ID NO: 3416 - protein, 19 aa, Homo sapiens
GHGLGHGHEQQHGLGHGHK

SEQ ID NO: 3417 - protein, 20 aa, Homo sapiens
GHGLGHGHEQQHGLGHGHKF

SEQ ID NO: 3418 - protein, 17 aa, Homo sapiens
GHLFLQTDQPIYNPGQR

SEQ ID NO: 3419 - protein, 10 aa, Homo sapiens
GHMLENHVER

SEQ ID NO: 3420 - protein, 13 aa, Homo sapiens
GHTPTQPGALNQR

SEQ ID NO: 3421 - protein, 13 aa, Homo sapiens
GHVSFKPSLDQQR

SEQ ID NO: 3422 - protein, 17 aa, Homo sapiens
GHYFWMLSPFSPPSPAR

SEQ ID NO: 3423 - protein, 9 aa, Homo sapiens
GIDQNMFQK

SEQ ID NO: 3424 - protein, 15 aa, Homo sapiens
GILAADESVGTMGNR

SEQ ID NO: 3425 - protein, 9 aa, Homo sapiens
GILNEIKDR

SEQ ID NO: 3426 - protein, 7 aa, Homo sapiens
GISMLNK

SEQ ID NO: 3427 - protein, 22 aa, Homo sapiens
GISPFHEHAEVVFTANDSGPRR

SEQ ID NO: 3428 - protein, 17 aa, Homo sapiens
GIVAAFYSGPSLSDKEK

SEQ ID NO: 3429 - protein, 8 aa, Homo sapiens
GIYGTISR

SEQ ID NO: 3430 - protein, 15 aa, Homo sapiens
GKEESLDSDLYAELR

SEQ ID NO: 3431 - protein, 12 aa, Homo sapiens
GKEYFAIDNSGR

SEQ ID NO: 3432 - protein, 9 aa, Homo sapiens
GKIIHFGTR

SEQ ID NO: 3433 - protein, 8 aa, Homo sapiens
GKITDLIK

SEQ ID NO: 3434 - protein, 25 aa, Homo sapiens
GKITDLIKDLDSQTMMVLVNYIFFK

SEQ ID NO: 3435 - protein, 12 aa, Homo sapiens
GKIVDLVSELKK

SEQ ID NO: 3436 - protein, 11 aa, Homo sapiens
GKPVQGVAYVR

SEQ ID NO: 3437 - protein, 8 aa, Homo sapiens
GKTAGLVR

SEQ ID NO: 3438 - protein, 23 aa, Homo sapiens
GKWLTPFDPVFTEVDTFHLDKYK

SEQ ID NO: 3439 - protein, 8 aa, Homo sapiens
GKYEMYLK

SEQ ID NO: 3440 - protein, 15 aa, Homo sapiens
GLASANVDFAFSLYK

SEQ ID NO: 3441 - protein, 13 aa, Homo sapiens
GLEEELQFSLGSK

SEQ ID NO: 3442 - protein, 10 aa, Homo sapiens
GLEQGIQDNK

SEQ ID NO: 3443 - protein, 9 aa, Homo sapiens
GLEWVANIK

SEQ ID NO: 3444 - protein, 16 aa, Homo sapiens
GLGELQELYLKGNELK

SEQ ID NO: 3445 - protein, 9 aa, Homo sapiens
GLLDEDGKK

SEQ ID NO: 3446 - protein, 14 aa, Homo sapiens
GLLEDTFPGLLGLR

SEQ ID NO: 3447 - protein, 13 aa, Homo sapiens
GLLRPDYALLGHR

SEQ ID NO: 3448 - protein, 9 aa, Homo sapiens
GLQDEDGYR

SEQ ID NO: 3449 - protein, 11 aa, Homo sapiens
GLQVALEEFHK

SEQ ID NO: 3450 - protein, 8 aa, Homo sapiens
GLRETLSR

SEQ ID NO: 3451 - protein, 8 aa, Homo sapiens
GLSAIRER

SEQ ID NO: 3452 - protein, 24 aa, Homo sapiens
GLSHPFSIDVFEDYIYGVTYINNR

SEQ ID NO: 3453 - protein, 12 aa, Homo sapiens
GLYYFTYHASSR

SEQ ID NO: 3454 - protein, 28 aa, Homo sapiens
GMADQDGLKPTIDKPSEDSPPLEMLGPR

SEQ ID NO: 3455 - protein, 21 aa, Homo sapiens
GMGNEIDLHTVHFHGHSFQYK

SEQ ID NO: 3456 - protein, 12 aa, Homo sapiens
GMNLASFFSASK

SEQ ID NO: 3457 - protein, 11 aa, Homo sapiens
GMTNINDGLLR

SEQ ID NO: 3458 - protein, 9 aa, Homo sapiens
GNDIIAAAK

SEQ ID NO: 3459 - protein, 12 aa, Homo sapiens
GNLRGNTEGLQK

SEQ ID NO: 3460 - protein, 9 aa, Homo sapiens
GNPAVSYVR

SEQ ID NO: 3461 - protein, 13 aa, Homo sapiens
GNPTVEVDLFTSK

SEQ ID NO: 3462 - protein, 11 aa, Homo sapiens
GNQDTSSQLKK

SEQ ID NO: 3463 - protein, 10 aa, Homo sapiens
GNSYFMVEVK

SEQ ID NO: 3464 - protein, 10 aa, Homo sapiens
GPDPSSPAFR

SEQ ID NO: 3465 - protein, 12 aa, Homo sapiens
GPDVLTATVSGK

SEQ ID NO: 3466 - protein, 23 aa, Homo sapiens
GPEEEHLGILGPVIWAEVGDTIR

SEQ ID NO: 3467 - protein, 14 aa, Homo sapiens
GPEVQLVAHSPWLK

SEQ ID NO: 3468 - protein, 19 aa, Homo sapiens
GPEVQLVAHSPWLKDSLSR

SEQ ID NO: 3469 - protein, 9 aa, Homo sapiens
GPGVDQEPR

SEQ ID NO: 3470 - protein, 16 aa, Homo sapiens
GPHAGDVEGHLSFLEK

SEQ ID NO: 3471 - protein, 21 aa, Homo sapiens
GPLLVQDVVFTDEMAHFDRER

SEQ ID NO: 3472 - protein, 7 aa, Homo sapiens
GPLQLER

SEQ ID NO: 3473 - protein, 13 aa, Homo sapiens
GPQLHADVGDKVK

SEQ ID NO: 3474 - protein, 12 aa, Homo sapiens
GPSVFPLAPSSK

SEQ ID NO: 3475 - protein, 9 aa, Homo sapiens
GPTQEFKKR

SEQ ID NO: 3476 - protein, 13 aa, Homo sapiens
GPVGLAIDFPESK

SEQ ID NO: 3477 - protein, 11 aa, Homo sapiens
GPVLQLHDLKR

SEQ ID NO: 3478 - protein, 17 aa, Homo sapiens
GQESSTDIKAPEGFAVR

SEQ ID NO: 3479 - protein, 8 aa, Homo sapiens
GQIVFMNR

SEQ ID NO: 3480 - protein, 11 aa, Homo sapiens
GQIVFMNREPK

SEQ ID NO: 3481 - protein, 12 aa, Homo sapiens
GQIVFMNREPKR

SEQ ID NO: 3482 - protein, 8 aa, Homo sapiens
GQPLSPEK

SEQ ID NO: 3483 - protein, 23 aa, Homo sapiens
GQPLSPEKYVTSAPMPEPQAPGR

SEQ ID NO: 3484 - protein, 14 aa, Homo sapiens
GQSEDPGSLLSLFR

SEQ ID NO: 3485 - protein, 9 aa, Homo sapiens
GQTLLAVAK

SEQ ID NO: 3486 - protein, 9 aa, Homo sapiens
GQYASPTAK

SEQ ID NO: 3487 - protein, 29 aa, Homo sapiens
GRFPLYNLGFGHNVDFNFLEVMSMENNGR

SEQ ID NO: 3488 - protein, 14 aa, Homo sapiens
GRPQGPPQQGGHQQ

SEQ ID NO: 3489 - protein, 9 aa, Homo sapiens
GRQYLIMGK

SEQ ID NO: 3490 - protein, 19 aa, Homo sapiens
GRVTGWGNLKETWTANVGK

SEQ ID NO: 3491 - protein, 37 aa, Homo sapiens
GSAEAELMSVVPVFYVFHYLETGNHWNIFHSDPLIEK

SEQ ID NO: 3492 - protein, 13 aa, Homo sapiens
GSDTFYSFKYEIK

SEQ ID NO: 3493 - protein, 17 aa, Homo sapiens
GSEAFATDFQDSAAAKK

SEQ ID NO: 3494 - protein, 14 aa, Homo sapiens
GSEAINAPGDNPAK

SEQ ID NO: 3495 - protein, 9 aa, Homo sapiens
GSEMVVAGK

SEQ ID NO: 3496 - protein, 13 aa, Homo sapiens
GSFEFPVGDAVSK

SEQ ID NO: 3497 - protein, 8 aa, Homo sapiens
GSFPWQAK

SEQ ID NO: 3498 - protein, 16 aa, Homo sapiens
GSGATFSHYYYMILSR

SEQ ID NO: 3499 - protein, 11 aa, Homo sapiens
GSKGPLDQLEK

SEQ ID NO: 3500 - protein, 9 aa, Homo sapiens
GSLLNNAIK

SEQ ID NO: 3501 - protein, 13 aa, Homo sapiens
GSPAINVAVHVFR

SEQ ID NO: 3502 - protein, 14 aa, Homo sapiens
GSPAINVAVHVFRK

SEQ ID NO: 3503 - protein, 11 aa, Homo sapiens
GSPSGEVSHPR

SEQ ID NO: 3504 - protein, 9 aa, Homo sapiens
GSQAVSYTR

SEQ ID NO: 3505 - protein, 13 aa, Homo sapiens
GSTGVAAAAGLHR

SEQ ID NO: 3506 - protein, 10 aa, Homo sapiens
GSVFLRNPSR

SEQ ID NO: 3507 - protein, 12 aa, Homo sapiens
GSVQYLPDLDDK

SEQ ID NO: 3508 - protein, 12 aa, Homo sapiens
GSWSTLKTQDQK

SEQ ID NO: 3509 - protein, 18 aa, Homo sapiens
GSWVNKFPVEMTHNHNFR

SEQ ID NO: 3510 - protein, 12 aa, Homo sapiens
GTDYHKQPWQAK

SEQ ID NO: 3511 - protein, 29 aa, Homo sapiens
GTEAAAVPEVELSDQPENTFLHPIIQIDR

SEQ ID NO: 3512 - protein, 11 aa, Homo sapiens
GTFTDTEDPAK

SEQ ID NO: 3513 - protein, 21 aa, Homo sapiens
GTHVDLGLASANVDFAFSLYK

SEQ ID NO: 3514 - protein, 8 aa, Homo sapiens
GTLLALER

SEQ ID NO: 3515 - protein, 26 aa, Homo sapiens
GTVIDVTDFVNWASSINDAPVLISQK

SEQ ID NO: 3516 - protein, 7 aa, Homo sapiens
GTVYNYR

SEQ ID NO: 3517 - protein, 13 aa, Homo sapiens
GTWTQPFDLASTR

SEQ ID NO: 3518 - protein, 10 aa, Homo sapiens
GTYSTTVTGR

SEQ ID NO: 3519 - protein, 16 aa, Homo sapiens
GVALHRPDVYLLPPAR

SEQ ID NO: 3520 - protein, 22 aa, Homo sapiens
GVALHRPDVYLLPPAREQLNLR

SEQ ID NO: 3521 - protein, 15 aa, Homo sapiens
GVAQEPVHLDSPAIK

SEQ ID NO: 3522 - protein, 9 aa, Homo sapiens
GVELKDIKR

SEQ ID NO: 3523 - protein, 12 aa, Homo sapiens
GVPIPNKVIFIR

SEQ ID NO: 3524 - protein, 12 aa, Homo sapiens
GVRPSQGGEAPR

SEQ ID NO: 3525 - protein, 7 aa, Homo sapiens
GVTFLLR

SEQ ID NO: 3526 - protein, 17 aa, Homo sapiens
GVTSVSQIFHSPDLAIR

SEQ ID NO: 3527 - protein, 23 aa, Homo sapiens
GVVPLAGTNGETTTQGLDGLSER

SEQ ID NO: 3528 - protein, 23 aa, Homo sapiens
GVYSSDVFDIFPGTYQTLEMFPR

SEQ ID NO: 3529 - protein, 15 aa, Homo sapiens
GWHWVGAHTLGHNSR

SEQ ID NO: 3530 - protein, 9 aa, Homo sapiens
GWVDLFVPK

SEQ ID NO: 3531 - protein, 7 aa, Homo sapiens
GYGFYTK

SEQ ID NO: 3532 - protein, 9 aa, Homo sapiens
GYGNSDYKR

SEQ ID NO: 3533 - protein, 10 aa, Homo sapiens
GYHLNEEGTR

SEQ ID NO: 3534 - protein, 7 aa, Homo sapiens
GYHLVGK

SEQ ID NO: 3535 - protein, 8 aa, Homo sapiens
GYHLVGKK

SEQ ID NO: 3536 - protein, 9 aa, Homo sapiens
GYLNTGYQR

SEQ ID NO: 3537 - protein, 10 aa, Homo sapiens
GYSFTTTAER

SEQ ID NO: 3538 - protein, 9 aa, Homo sapiens
GYTLADNGK

SEQ ID NO: 3539 - protein, 11 aa, Homo sapiens
GYVIIKPLVWV

SEQ ID NO: 3540 - protein, 8 aa, Homo sapiens
HADPDFTR

SEQ ID NO: 3541 - protein, 9 aa, Homo sapiens
HADPDFTRK

SEQ ID NO: 3542 - protein, 9 aa, Homo sapiens
HAFILQDTK

SEQ ID NO: 3543 - protein, 10 aa, Homo sapiens
HAIILLTDGK

SEQ ID NO: 3544 - protein, 18 aa, Homo sapiens
HAIILLTDGKSNMGGSPK

SEQ ID NO: 3545 - protein, 8 aa, Homo sapiens
HANEVSQK

SEQ ID NO: 3546 - protein, 9 aa, Homo sapiens
HDASALDIR

SEQ ID NO: 3547 - protein, 36 aa, Homo sapiens
HDVREGKEYGVVLAPDGSTVAVEPLLAGLEAGLQGR

SEQ ID NO: 3548 - protein, 21 aa, Homo sapiens
HELTDEELQSLFTNFANVVDK

SEQ ID NO: 3549 - protein, 7 aa, Homo sapiens
HFQNLGK

SEQ ID NO: 3550 - protein, 11 aa, Homo sapiens
HFQNLGKDGLK

SEQ ID NO: 3551 - protein, 14 aa, Homo sapiens
HGATYAFSGTHYWR

SEQ ID NO: 3552 - protein, 22 aa, Homo sapiens
HGESGSMAVFHQTQGPSYSESK

SEQ ID NO: 3553 - protein, 9 aa, Homo sapiens
HGGLYHENM

SEQ ID NO: 3554 - protein, 10 aa, Homo sapiens
HGGLYHENMR

SEQ ID NO: 3555 - protein, 9 aa, Homo sapiens
HGGPLPYHR

SEQ ID NO: 3556 - protein, 16 aa, Homo sapiens
HGLSNSIYVFVRDPAK

SEQ ID NO: 3557 - protein, 13 aa, Homo sapiens
HGNTDSEGIVEVK

SEQ ID NO: 3558 - protein, 8 aa, Homo sapiens
HGPGLIYR

SEQ ID NO: 3559 - protein, 9 aa, Homo sapiens
HHGPTITAK

SEQ ID NO: 3560 - protein, 10 aa, Homo sapiens
HHLGLEEPKK

SEQ ID NO: 3561 - protein, 15 aa, Homo sapiens
HHPDFEVFVFDVGQK

SEQ ID NO: 3562 - protein, 11 aa, Homo sapiens
HHPEHFSGRPR

SEQ ID NO: 3563 - protein, 7 aa, Homo sapiens
HIANVER

SEQ ID NO: 3564 - protein, 10 aa, Homo sapiens
HIDREFVVMF

SEQ ID NO: 3565 - protein, 17 aa, Homo sapiens
HIGIISFPDFKIPSNPR

SEQ ID NO: 3566 - protein, 11 aa, Homo sapiens
HIGWKDFTAYR

SEQ ID NO: 3567 - protein, 9 aa, Homo sapiens
HITSLEVIK

SEQ ID NO: 3568 - protein, 11 aa, Homo sapiens
HIVTFDGQNFK

SEQ ID NO: 3569 - protein, 9 aa, Homo sapiens
HKGALHNYK

SEQ ID NO: 3570 - protein, 10 aa, Homo sapiens
HKGKYEMYLK

SEQ ID NO: 3571 - protein, 10 aa, Homo sapiens
HLAPYSDELR

SEQ ID NO: 3572 - protein, 15 aa, Homo sapiens
HLDSVLQQLQTEVYR

SEQ ID NO: 3573 - protein, 9 aa, Homo sapiens
HLEDVFSKR

SEQ ID NO: 3574 - protein, 14 aa, Homo sapiens
HLEVDVWVIEPQGL

SEQ ID NO: 3575 - protein, 15 aa, Homo sapiens
HLEVDVWVIEPQGLR

SEQ ID NO: 3576 - protein, 7 aa, Homo sapiens
HLKPLAK

SEQ ID NO: 3577 - protein, 16 aa, Homo sapiens
HLLHTLNLPGHGLETR

SEQ ID NO: 3578 - protein, 8 aa, Homo sapiens
HLRLDGNR

SEQ ID NO: 3579 - protein, 8 aa, Homo sapiens
HLVALSPK

SEQ ID NO: 3580 - protein, 9 aa, Homo sapiens
HLVALSPKK

SEQ ID NO: 3581 - protein, 15 aa, Homo sapiens
HLVPGAPFLLQALVR

SEQ ID NO: 3582 - protein, 6 aa, Homo sapiens
HNGMWR

SEQ ID NO: 3583 - protein, 7 aa, Homo sapiens
HPDMLTK

SEQ ID NO: 3584 - protein, 18 aa, Homo sapiens
HPNSPLDEENLTQENQDR

SEQ ID NO: 3585 - protein, 39 aa, Homo sapiens; identical to SEQ ID NO: 359

SEQ ID NO: 3586 - protein, 7 aa, Homo sapiens
HPTWPQK

SEQ ID NO: 3587 - protein, 10 aa, Homo sapiens
HQFLLTGDTQ

SEQ ID NO: 3588 - protein, 12 aa, Homo sapiens
HQFLLTGDTQGR

SEQ ID NO: 3589 - protein, 11 aa, Homo sapiens
HQGVMVGMGQK

SEQ ID NO: 3590 - protein, 24 aa, Homo sapiens
HQMDLVATLSQLGLQELFQAPDLR

SEQ ID NO: 3591 - protein, 25 aa, Homo sapiens
HRGVYSSDVFDIFPGTYQTLEMFPR

SEQ ID NO: 3592 - protein, 16 aa, Homo sapiens
HRLEDMEQALSPSVFK

SEQ ID NO: 3593 - protein, 24 aa, Homo sapiens
HRQGPVNLLSDPEQGVEVTGQYER

SEQ ID NO: 3594 - protein, 26 aa, Homo sapiens
HRQGPVNLLSDPEQGVEVTGQYEREK

SEQ ID NO: 3595 - protein, 15 aa, Homo sapiens
HSAQPWADFTLLGAR

SEQ ID NO: 3596 - protein, 9 aa, Homo sapiens
HSHESQDLR

SEQ ID NO: 3597 - protein, 11 aa, Homo sapiens
HSIFTPETNPR

SEQ ID NO: 3598 - protein, 13 aa, Homo sapiens
HSPQEAPHVQYER

SEQ ID NO: 3599 - protein, 18 aa, Homo sapiens
HTASAWLMSAPNSGPHNR

SEQ ID NO: 3600 - protein, 19 aa, Homo sapiens
HTFMGVVSLGSPSGEVSHP

SEQ ID NO: 3601 - protein, 20 aa, Homo sapiens
HTFMGVVSLGSPSGEVSHPR

SEQ ID NO: 3602 - protein, 9 aa, Homo sapiens
HTFTLSLPR

SEQ ID NO: 3603 - protein, 10 aa, Homo sapiens
HTLNQIDEVK

SEQ ID NO: 3604 - protein, 18 aa, Homo sapiens
HTSVQTTSSGSGPFTDVR

SEQ ID NO: 3605 - protein, 12 aa, Homo sapiens
HTVSGGSLLMAR

SEQ ID NO: 3606 - protein, 21 aa, Homo sapiens
HVEDVPAFQALGSLNDLQFFR

SEQ ID NO: 3607 - protein, 11 aa, Homo sapiens
HVEEPHTETVR

SEQ ID NO: 3608 - protein, 12 aa, Homo sapiens
HVEEPHTETVRK

SEQ ID NO: 3609 - protein, 25 aa, Homo sapiens
HVIILMTDGLHNMGGDPITVIDEIR

SEQ ID NO: 3610 - protein, 32 aa, Homo sapiens; identical to SEQ ID NO: 709

SEQ ID NO: 3611 - protein, 34 aa, Homo sapiens
HVIILMTDGLHNMGGDPITVIDEIRDLLYIGKDR

SEQ ID NO: 3612 - protein, 11 aa, Homo sapiens
HVLAAWALGAK

SEQ ID NO: 3613 - protein, 10 aa, Homo sapiens
HVLDPTPVAR

SEQ ID NO: 3614 - protein, 12 aa, Homo sapiens
HVSFKPTVAQQR

SEQ ID NO: 3615 - protein, 17 aa, Homo sapiens
HVSSPLASYFLSFPYAR

SEQ ID NO: 3616 - protein, 11 aa, Homo sapiens
HVVPNEVVVQR

SEQ ID NO: 3617 - protein, 22 aa, Homo sapiens
HVVYPTAWMNQLPLLAAIEIQK

SEQ ID NO: 3618 - protein, 12 aa, Homo sapiens
HYDGSYSTFGER

SEQ ID NO: 3619 - protein, 10 aa, Homo sapiens
HYEGSTVPEK

SEQ ID NO: 3620 - protein, 16 aa, Homo sapiens
HYGGLTGLNKAETAAK

SEQ ID NO: 3621 - protein, 10 aa, Homo sapiens
HYQINQQWER

SEQ ID NO: 3622 - protein, 20 aa, Homo sapiens
HYYESEVLAMNFQDWATASR

SEQ ID NO: 3623 - protein, 23 aa, Homo sapiens
HYYIAAEEIIWNYAPSGIDIFTK

SEQ ID NO: 3624 - protein, 20 aa, Homo sapiens
HYYIGIIETTWDYASDHGEK

SEQ ID NO: 3625 - protein, 21 aa, Homo sapiens
HYYIGIIETTWDYASDHGEKK

SEQ ID NO: 3626 - protein, 12 aa, Homo sapiens
IADDKYNDTFWK

SEQ ID NO: 3627 - protein, 10 aa, Homo sapiens
IADNKQSSFK

SEQ ID NO: 3628 - protein, 13 aa, Homo sapiens
IAELSATAQEIIK

SEQ ID NO: 3629 - protein, 6 aa, Homo sapiens
IAHDLR

SEQ ID NO: 3630 - protein, 7 aa, Homo sapiens
IAIDLFK

SEQ ID NO: 3631 - protein, 18 aa, Homo sapiens
IAKGGVNDNFQGVLQNVR

SEQ ID NO: 3632 - protein, 14 aa, Homo sapiens
IALGGLLFPASNLR

SEQ ID NO: 3633 - protein, 21 aa, Homo sapiens
IANDNSLNHEYLPILGLAEFR

SEQ ID NO: 3634 - protein, 11 aa, Homo sapiens
IAPANADFAFR

SEQ ID NO: 3635 - protein, 16 aa, Homo sapiens
IAPQLSTEELVSLGEK

SEQ ID NO: 3636 - protein, 19 aa, Homo sapiens
IAQLPLTGSMSIIFFLPLK

SEQ ID NO: 3637 - protein, 14 aa, Homo sapiens
IAQWQSFQLEGGLK

SEQ ID NO: 3638 - protein, 30 aa, Homo sapiens; identical to SEQ ID NO: 1034

SEQ ID NO: 3639 - protein, 7 aa, Homo sapiens
IAWHVIR

SEQ ID NO: 3640 - protein, 14 aa, Homo sapiens
IAYGTQGSSGYSLR

SEQ ID NO: 3641 - protein, 12 aa, Homo sapiens
IDAVYEAPQEEK

SEQ ID NO: 3642 - protein, 9 aa, Homo sapiens
IDQNVEELK

SEQ ID NO: 3643 - protein, 11 aa, Homo sapiens
IDQNVEELKGR

SEQ ID NO: 3644 - protein, 9 aa, Homo sapiens
IDQTVEELR

SEQ ID NO: 3645 - protein, 12 aa, Homo sapiens
IDRFMQAVTGWK

SEQ ID NO: 3646 - protein, 9 aa, Homo sapiens
IDSLLENDR

SEQ ID NO: 3647 - protein, 7 aa, Homo sapiens
IDTALIK

SEQ ID NO: 3648 - protein, 12 aa, Homo sapiens
IDTQDIEASHYR

SEQ ID NO: 3649 - protein, 10 aa, Homo sapiens
IDVHLVPDRK

SEQ ID NO: 3650 - protein, 7 aa, Homo sapiens
IDVHWTR

SEQ ID NO: 3651 - protein, 23 aa, Homo sapiens
IEDANLIPPVPDDKFQDLVDAVR

SEQ ID NO: 3652 - protein, 26 aa, Homo sapiens
IEDANLIPPVPDDKFQDLVDAVRAEK

SEQ ID NO: 3653 - protein, 24 aa, Homo sapiens
IEDGFSLKEQLQDMGLVDLFSPEK

SEQ ID NO: 3654 - protein, 17 aa, Homo sapiens
IEDLPTMVTLGNSFLHK

SEQ ID NO: 3655 - protein, 8 aa, Homo sapiens
IEEELGSK

SEQ ID NO: 3656 - protein, 7 aa, Homo sapiens
IEEIAAK

SEQ ID NO: 3657 - protein, 9 aa, Homo sapiens
IEEQLTLEK

SEQ ID NO: 3658 - protein, 20 aa, Homo sapiens
IEEVFKEVQNLKEIVNSLKK

SEQ ID NO: 3659 - protein, 20 aa, Homo sapiens
IEGNLIFDPNNYLPKESMLK

SEQ ID NO: 3660 - protein, 30 aa, Homo sapiens; identical to SEQ ID NO: 1752

SEQ ID NO: 3661 - protein, 15 aa, Homo sapiens
IEKPVWLGFLGPIIK

SEQ ID NO: 3662 - protein, 13 aa, Homo sapiens
IENVSYQDKGNYR

SEQ ID NO: 3663 - protein, 15 aa, Homo sapiens
IETTWDYASDHGEKK

SEQ ID NO: 3664 - protein, 12 aa, Homo sapiens
IEVQLKNEHTSK

SEQ ID NO: 3665 - protein, 9 aa, Homo sapiens
IFEGNTNTK

SEQ ID NO: 3666 - protein, 25 aa, Homo sapiens
IFELFEVGFLSPATFTVYEYHRPDK

SEQ ID NO: 3667 - protein, 16 aa, Homo sapiens
IFFYDSENPPASEVLR

SEQ ID NO: 3668 - protein, 22 aa, Homo sapiens
IFKYSHYNERDEIPHNDIALLK

SEQ ID NO: 3669 - protein, 16 aa, Homo sapiens
IFSPFADLSELSATGR

SEQ ID NO: 3670 - protein, 16 aa, Homo sapiens
IFYFSVPPFAYEDIAR

SEQ ID NO: 3671 - protein, 15 aa, Homo sapiens
IFYNQQNHYDGSTGK

SEQ ID NO: 3672 - protein, 6 aa, Homo sapiens
IGDNLR

SEQ ID NO: 3673 - protein, 11 aa, Homo sapiens
IGDNLRELQQR

SEQ ID NO: 3674 - protein, 16 aa, Homo sapiens
IGDQWDKQHDMGHMMR

SEQ ID NO: 3675 - protein, 7 aa, Homo sapiens
IGDTWSK

SEQ ID NO: 3676 - protein, 8 aa, Homo sapiens
IGDTWSKK

SEQ ID NO: 3677 - protein, 7 aa, Homo sapiens
IGEKWDR

SEQ ID NO: 3678 - protein, 10 aa, Homo sapiens
IHGILSNTHR

SEQ ID NO: 3679 - protein, 9 aa, Homo sapiens
IHIGSSFEK

SEQ ID NO: 3680 - protein, 16 aa, Homo sapiens
IHIGSSFEKYPLYVLK

SEQ ID NO: 3681 - protein, 29 aa, Homo sapiens
IHILPSMNPDGYEVAAAQGPNKPGYLVGR

SEQ ID NO: 3682 - protein, 6 aa, Homo sapiens
IHLDEK

SEQ ID NO: 3683 - protein, 7 aa, Homo sapiens
IHLMAGR

SEQ ID NO: 3684 - protein, 10 aa, Homo sapiens
IHSKEHFKEK

SEQ ID NO: 3685 - protein, 13 aa, Homo sapiens
IIDELNVKPEGTR

SEQ ID NO: 3686 - protein, 22 aa, Homo sapiens
IIFHENYNAGTYQNDIALIEMK

SEQ ID NO: 3687 - protein, 23 aa, Homo sapiens
IIFHENYNAGTYQNDIALIEMKK

SEQ ID NO: 3688 - protein, 7 aa, Homo sapiens
IIHFGTR

SEQ ID NO: 3689 - protein, 13 aa, Homo sapiens
IIPHHNYNAAINK

SEQ ID NO: 3690 - protein, 8 aa, Homo sapiens
IIYKENER

SEQ ID NO: 3691 - protein, 7 aa, Homo sapiens
IKFDKYK

SEQ ID NO: 3692 - protein, 10 aa, Homo sapiens
IKFDKYKAEK

SEQ ID NO: 3693 - protein, 10 aa, Homo sapiens
IKIIAPPERK

SEQ ID NO: 3694 - protein, 13 aa, Homo sapiens
IKPATWETGISMR

SEQ ID NO: 3695 - protein, 7 aa, Homo sapiens
IKSLLPK

SEQ ID NO: 3696 - protein, 11 aa, Homo sapiens
IKSSFVAPLEK

SEQ ID NO: 3697 - protein, 21 aa, Homo sapiens
IKTDGAAPNVAPSDVGGGGGR

SEQ ID NO: 3698 - protein, 9 aa, Homo sapiens
IKVPVDWNR

SEQ ID NO: 3699 - protein, 13 aa, Homo sapiens
ILAGPAGDSNVVK

SEQ ID NO: 3700 - protein, 37 aa, Homo sapiens
ILDDLSPRDQFNLIVFSTEATQWRPSLVPASAENVNK

SEQ ID NO: 3701 - protein, 39 aa, Homo sapiens
ILEDMQEEDYLNFILFSGDVSTWKEHLVQATPENLQEAR

SEQ ID NO: 3702 - protein, 10 aa, Homo sapiens
ILEGFQPSGR

SEQ ID NO: 3703 - protein, 19 aa, Homo sapiens
ILGDMQPGDYFDLVLFGTR

SEQ ID NO: 3704 - protein, 18 aa, Homo sapiens
ILGDPEALRDLLNNHILK

SEQ ID NO: 3705 - protein, 19 aa, Homo sapiens
ILGEELGFASLHDLQLLGK

SEQ ID NO: 3706 - protein, 9 aa, Homo sapiens
ILGPLSYSK

SEQ ID NO: 3707 - protein, 20 aa, Homo sapiens
ILLQGTPVAQMTEDAVDAER

SEQ ID NO: 3708 - protein, 8 aa, Homo sapiens
ILQADQEL

SEQ ID NO: 3709 - protein, 18 aa, Homo sapiens
ILTVPGHLDEMQLDIQAR

SEQ ID NO: 3710 - protein, 14 aa, Homo sapiens
ILTYQYGIPTSLQK

SEQ ID NO: 3711 - protein, 17 aa, Homo sapiens
IMADSGPIYDKTYAGGR

SEQ ID NO: 3712 - protein, 9 aa, Homo sapiens
IMGITLVSK

SEQ ID NO: 3713 - protein, 10 aa, Homo sapiens
IMQSSQSMSK

SEQ ID NO: 3714 - protein, 12 aa, Homo sapiens
INNQLTLDSNTK

SEQ ID NO: 3715 - protein, 11 aa, Homo sapiens
IPPWEAPKEHK

SEQ ID NO: 3716 - protein, 7 aa, Homo sapiens
IPSAQQR

SEQ ID NO: 3717 - protein, 9 aa, Homo sapiens
IPTTFENGR

SEQ ID NO: 3718 - protein, 22 aa, Homo sapiens
IPVIEPSVPELVVKPGATVTLR

SEQ ID NO: 3719 - protein, 27 aa, Homo sapiens
IQEFLSGLPEDTVLLLLNAIHFQGFWR

SEQ ID NO: 3720 - protein, 6 aa, Homo sapiens
IQENVR

SEQ ID NO: 3721 - protein, 15 aa, Homo sapiens
IQPSGGTNINEALLR

SEQ ID NO: 3722 - protein, 9 aa, Homo sapiens
IQVWHEEHR

SEQ ID NO: 3723 - protein, 13 aa, Homo sapiens
IQVYSRHPAENGK

SEQ ID NO: 3724 - protein, 6 aa, Homo sapiens
IRHFKV

SEQ ID NO: 3725 - protein, 13 aa, Homo sapiens
IRHHPEHFSGRPR

SEQ ID NO: 3726 - protein, 8 aa, Homo sapiens
IRWKNEVR

SEQ ID NO: 3727 - protein, 9 aa, Homo sapiens
ISASAEELR

SEQ ID NO: 3728 - protein, 10 aa, Homo sapiens
ISASAEELRQ

SEQ ID NO: 3729 - protein, 11 aa, Homo sapiens
ISASAEELRQR

SEQ ID NO: 3730 - protein, 13 aa, Homo sapiens
ISEGLPALEFPNE

SEQ ID NO: 3731 - protein, 11 aa, Homo sapiens
ISELKAEAVKK

SEQ ID NO: 3732 - protein, 12 aa, Homo sapiens
ISGMAPRPSLAK

SEQ ID NO: 3733 - protein, 6 aa, Homo sapiens
ISNIIK

SEQ ID NO: 3734 - protein, 11 aa, Homo sapiens
ISNIPDEYFKR

SEQ ID NO: 3735 - protein, 11 aa, Homo sapiens
ISPGFDVFAKK

SEQ ID NO: 3736 - protein, 8 aa, Homo sapiens
ISVIRPSK

SEQ ID NO: 3737 - protein, 17 aa, Homo sapiens
ISVNNVLPVFDNLMQQK

SEQ ID NO: 3738 - protein, 6 aa, Homo sapiens
ITDLIK

SEQ ID NO: 3739 - protein, 23 aa, Homo sapiens
ITDLIKDLDSQTMMVLVNYIFFK

SEQ ID NO: 3740 - protein, 25 aa, Homo sapiens
ITDVIPSEAINELTVLVLVNTIYFK

SEQ ID NO: 3741 - protein, 6 aa, Homo sapiens
ITEATK

SEQ ID NO: 3742 - protein, 16 aa, Homo sapiens
ITEGVPQLLIVLTADR

SEQ ID NO: 3743 - protein, 7 aa, Homo sapiens
ITGKPIK

SEQ ID NO: 3744 - protein, 14 aa, Homo sapiens
ITGKPIKLTQVEHR

SEQ ID NO: 3745 - protein, 21 aa, Homo sapiens
ITGTMPPLPLEATGLALSSLR

SEQ ID NO: 3746 - protein, 16 aa, Homo sapiens
ITGYIIKYEKPGSPPR

SEQ ID NO: 3747 - protein, 9 aa, Homo sapiens
ITHVHVHMR

SEQ ID NO: 3748 - protein, 11 aa, Homo sapiens
ITHYNYLILSK

SEQ ID NO: 3749 - protein, 11 aa, Homo sapiens
ITLLSALVETR

SEQ ID NO: 3750 - protein, 11 aa, Homo sapiens
ITMLGIQGDLK

SEQ ID NO: 3751 - protein, 25 aa, Homo sapiens
ITPGKPYILTVPGHLDEMQLDIQAR

SEQ ID NO: 3752 - protein, 14 aa, Homo sapiens
ITPNLAEFAFSLYR

SEQ ID NO: 3753 - protein, 8 aa, Homo sapiens
ITQDAQLK

SEQ ID NO: 3754 - protein, 11 aa, Homo sapiens
ITQDAQLKSSK

SEQ ID NO: 3755 - protein, 9 aa, Homo sapiens
ITQVLHFTK

SEQ ID NO: 3756 - protein, 12 aa, Homo sapiens
ITQVLHFTKDVK

SEQ ID NO: 3757 - protein, 12 aa, Homo sapiens
ITTAKENYDNAK

SEQ ID NO: 3758 - protein, 28 aa, Homo sapiens
ITTGGDVINNGLWNMVSVEELEHSISIK

SEQ ID NO: 3759 - protein, 20 aa, Homo sapiens
ITVVAGEHNIEETEHTEQKR

SEQ ID NO: 3760 - protein, 20 aa, Homo sapiens
ITVVDALHEIPVKKGEGAEL

SEQ ID NO: 3761 - protein, 14 aa, Homo sapiens
IVADKDYSVTANSK

SEQ ID NO: 3762 - protein, 20 aa, Homo sapiens
IVASTLSNPELFEEWTGNVK

SEQ ID NO: 3763 - protein, 23 aa, Homo sapiens
IVDLFSGLDSPAILVLVNYIFFK

SEQ ID NO: 3764 - protein, 10 aa, Homo sapiens
IVDLVSELKK

SEQ ID NO: 3765 - protein, 20 aa, Homo sapiens
IVEGSDAEIGMSPWQVMLFR

SEQ ID NO: 3766 - protein, 21 aa, Homo sapiens
IVEGSDAEIGMSPWQVMLFRK

SEQ ID NO: 3767 - protein, 14 aa, Homo sapiens
IVFPHGITLDLVSR

SEQ ID NO: 3768 - protein, 8 aa, Homo sapiens
IVIEYVDR

SEQ ID NO: 3769 - protein, 8 aa, Homo sapiens
IVKWDRDM

SEQ ID NO: 3770 - protein, 13 aa, Homo sapiens
IVLGQEQDSYGGK

SEQ ID NO: 3771 - protein, 16 aa, Homo sapiens
IVLGQEQDSYGGKFDR

SEQ ID NO: 3772 - protein, 6 aa, Homo sapiens
IVQIYK

SEQ ID NO: 3773 - protein, 10 aa, Homo sapiens
IVQIYKDLLR

SEQ ID NO: 3774 - protein, 19 aa, Homo sapiens
IVSSAMEPDREYHFGQAVR

SEQ ID NO: 3775 - protein, 10 aa, Homo sapiens
IVTSTYKDGK

SEQ ID NO: 3776 - protein, 12 aa, Homo sapiens
IVYREYEPYFKK

SEQ ID NO: 3777 - protein, 11 aa, Homo sapiens
IWHHTFYNELR

SEQ ID NO: 3778 - protein, 7 aa, Homo sapiens
IWLDNVR

SEQ ID NO: 3779 - protein, 20 aa, Homo sapiens
IYEDHDATQQLQGFYSQVAK

SEQ ID NO: 3780 - protein, 8 aa, Homo sapiens
IYFQAASR

SEQ ID NO: 3781 - protein, 6 aa, Homo sapiens
IYGGFK

SEQ ID NO: 3782 - protein, 13 aa, Homo sapiens
IYGKPVQGVAYVR

SEQ ID NO: 3783 - protein, 12 aa, Homo sapiens
IYGNQDTSSQLK

SEQ ID NO: 3784 - protein, 13 aa, Homo sapiens
IYGNQDTSSQLKK

SEQ ID NO: 3785 - protein, 10 aa, Homo sapiens
IYHSHIDAPK

SEQ ID NO: 3786 - protein, 9 aa, Homo sapiens
IYISGMAPR

SEQ ID NO: 3787 - protein, 10 aa, Homo sapiens
IYISGMAPRP

SEQ ID NO: 3788 - protein, 14 aa, Homo sapiens
IYISGMAPRPSLAK

SEQ ID NO: 3789 - protein, 15 aa, Homo sapiens
IYISGMAPRPSLAKK

SEQ ID NO: 3790 - protein, 7 aa, Homo sapiens
IYLQPGR

SEQ ID NO: 3791 - protein, 11 aa, Homo sapiens
IYLYTLNDNAR

SEQ ID NO: 3792 - protein, 10 aa, Homo sapiens
IYSLWEHSTK

SEQ ID NO: 3793 - protein, 19 aa, Homo sapiens
IYTSPTWSAFVTDSSWSAR

SEQ ID NO: 3794 - protein, 21 aa, Homo sapiens
IYWADAREDYIEFASLDGSNR

SEQ ID NO: 3795 - protein, 13 aa, Homo sapiens
KAAISGENAGLVR

SEQ ID NO: 3796 - protein, 13 aa, Homo sapiens
KAALKTASDFITK

SEQ ID NO: 3797 - protein, 8 aa, Homo sapiens
KAALSMCK

SEQ ID NO: 3798 - protein, 12 aa, Homo sapiens
KADGSYAAWLSR

SEQ ID NO: 3799 - protein, 21 aa, Homo sapiens
KAEEEHLGILGPQLHADVGDK

SEQ ID NO: 3800 - protein, 23 aa, Homo sapiens
KAEEEHLGILGPQLHADVGDKVK

SEQ ID NO: 3801 - protein, 7 aa, Homo sapiens
KAFVFPK

SEQ ID NO: 3802 - protein, 8 aa, Homo sapiens
KAITQVSK

SEQ ID NO: 3803 - protein, 11 aa, Homo sapiens
KALETYEIIFK

SEQ ID NO: 3804 - protein, 11 aa, Homo sapiens
KALFVSEEEKK

SEQ ID NO: 3805 - protein, 9 aa, Homo sapiens
KALQTEMAR

SEQ ID NO: 3806 - protein, 13 aa, Homo sapiens
KALYLQYTDETFR

SEQ ID NO: 3807 - protein, 11 aa, Homo sapiens
KAMAVEDIISR

SEQ ID NO: 3808 - protein, 12 aa, Homo sapiens
KANQQLNFTEAK

SEQ ID NO: 3809 - protein, 18 aa, Homo sapiens
KATEDEGSEQKIPEATNR

SEQ ID NO: 3810 - protein, 19 aa, Homo sapiens
KATEDEGSEQKIPEATNRR

SEQ ID NO: 3811 - protein, 6 aa, Homo sapiens
KATIQK

SEQ ID NO: 3812 - protein, 10 aa, Homo sapiens
KATVVYQGER

SEQ ID NO: 3813 - protein, 28 aa, Homo sapiens
KDDIMLDEGMLQSLMELPDQYNYGMYAK

SEQ ID NO: 3814 - protein, 15 aa, Homo sapiens
KDHSGQVFSVVSNGK

SEQ ID NO: 3815 - protein, 9 aa, Homo sapiens
KDMVEYKDR

SEQ ID NO: 3816 - protein, 9 aa, Homo sapiens
KDNEQHVFK

SEQ ID NO: 3817 - protein, 11 aa, Homo sapiens
KDNEQHVFKVK

SEQ ID NO: 3818 - protein, 14 aa, Homo sapiens
KDNSVHWERPQKPK

SEQ ID NO: 3819 - protein, 29 aa, Homo sapiens
KDPEGLFLQDNIVAEFSVDETGQMSATAK

SEQ ID NO: 3820 - protein, 31 aa, Homo sapiens; identical to SEQ ID NO: 1887

SEQ ID NO: 3821 - protein, 17 aa, Homo sapiens
KEAGIPEFYDYDVALIK

SEQ ID NO: 3822 - protein, 13 aa, Homo sapiens
KEEFHEQSFRVEK

SEQ ID NO: 3823 - protein, 12 aa, Homo sapiens
KEEIGKELEELR

SEQ ID NO: 3824 - protein, 10 aa, Homo sapiens
KEFDHNSNIR

SEQ ID NO: 3825 - protein, 14 aa, Homo sapiens
KEFPYRIPLDLVPK

SEQ ID NO: 3826 - protein, 18 aa, Homo sapiens
KEGGLGPLNIPLLADVTR

SEQ ID NO: 3827 - protein, 19 aa, Homo sapiens
KEGGLGPLNIPLLADVTRR

SEQ ID NO: 3828 - protein, 23 aa, Homo sapiens
KEKHYYIGIIETTWDYASDHGEK

SEQ ID NO: 3829 - protein, 15 aa, Homo sapiens
KELELQIGNALFIGK

SEQ ID NO: 3830 - protein, 6 aa, Homo sapiens
KELGAK

SEQ ID NO: 3831 - protein, 8 aa, Homo sapiens
KENFDKAR

SEQ ID NO: 3832 - protein, 26 aa, Homo sapiens
KERGPEEEHLGILGPVIWAEVGDTIR

SEQ ID NO: 3833 - protein, 6 aa, Homo sapiens
KEVYIK

SEQ ID NO: 3834 - protein, 6 aa, Homo sapiens
KEYEMK

SEQ ID NO: 3835 - protein, 6 aa, Homo sapiens
KFIFTR

SEQ ID NO: 3836 - protein, 15 aa, Homo sapiens
KFPSGTFEQVSQLVK

SEQ ID NO: 3837 - protein, 12 aa, Homo sapiens
KFYNQVSTPLLR

SEQ ID NO: 3838 - protein, 21 aa, Homo sapiens
KGEVLPLPEANFPSFPLPHHK

SEQ ID NO: 3839 - protein, 11 aa, Homo sapiens
KGEWVALNPLR

SEQ ID NO: 3840 - protein, 12 aa, Homo sapiens
KGEWVALNPLRK

SEQ ID NO: 3841 - protein, 20 aa, Homo sapiens
KGGVASGFKHVVPNEVVVQR

SEQ ID NO: 3842 - protein, 11 aa, Homo sapiens
KGHIYQGSEAD

SEQ ID NO: 3843 - protein, 14 aa, Homo sapiens
KGHVSFKPSLDQQR

SEQ ID NO: 3844 - protein, 16 aa, Homo sapiens
KGKEESLDSDLYAELR

SEQ ID NO: 3845 - protein, 12 aa, Homo sapiens
KGNVATEISTER

SEQ ID NO: 3846 - protein, 13 aa, Homo sapiens
KGTDYHKQPWQAK

SEQ ID NO: 3847 - protein, 10 aa, Homo sapiens
KGVELKDIKR

SEQ ID NO: 3848 - protein, 14 aa, Homo sapiens
KGVSHGQFFDQHLK

SEQ ID NO: 3849 - protein, 10 aa, Homo sapiens
KGYTQQLAFR

SEQ ID NO: 3850 - protein, 10 aa, Homo sapiens
KIDQTVEELR

SEQ ID NO: 3851 - protein, 11 aa, Homo sapiens
KIDQTVEELRR

SEQ ID NO: 3852 - protein, 8 aa, Homo sapiens
KIEEIAAK

SEQ ID NO: 3853 - protein, 18 aa, Homo sapiens
KIMADSGPIYDKTYAGGR

SEQ ID NO: 3854 - protein, 6 aa, Homo sapiens
KIQIQR

SEQ ID NO: 3855 - protein, 16 aa, Homo sapiens
KITEVALMGHLSCDTK

SEQ ID NO: 3856 - protein, 11 aa, Homo sapiens
KKAETGDTVLK

SEQ ID NO: 3857 - protein, 12 aa, Homo sapiens
KKDQYKVGEVLK

SEQ ID NO: 3858 - protein, 27 aa, Homo sapiens
KKEVYMPSSIFQDDFVIPDISEPGTWK

SEQ ID NO: 3859 - protein, 8 aa, Homo sapiens
KKPGIYTR

SEQ ID NO: 3860 - protein, 19 aa, Homo sapiens
KLDDDLEHQGGHVLDHGHK

SEQ ID NO: 3861 - protein, 9 aa, Homo sapiens
KLEAMTNSK

SEQ ID NO: 3862 - protein, 8 aa, Homo sapiens
KLELHLPK

SEQ ID NO: 3863 - protein, 11 aa, Homo sapiens
KLEQTKEALLR

SEQ ID NO: 3864 - protein, 8 aa, Homo sapiens
KLGSYEHR

SEQ ID NO: 3865 - protein, 8 aa, Homo sapiens
KLINDYVK

SEQ ID NO: 3866 - protein, 20 aa, Homo sapiens
KLISVDTEHSNIYLQNGPDR

SEQ ID NO: 3867 - protein, 23 aa, Homo sapiens
KLISVDTEHSNIYLQNGPDRIGR

SEQ ID NO: 3868 - protein, 13 aa, Homo sapiens
KLKEGMLSIMSYR

SEQ ID NO: 3869 - protein, 19 aa, Homo sapiens
KLLEMEEQAAFLVGSATPR

SEQ ID NO: 3870 - protein, 11 aa, Homo sapiens
KLSFYYLIMAK

SEQ ID NO: 3871 - protein, 11 aa, Homo sapiens
KLTISEQNIQR

SEQ ID NO: 3872 - protein, 12 aa, Homo sapiens
KLVPFATELHER

SEQ ID NO: 3873 - protein, 16 aa, Homo sapiens
KLVYREYTDASFTNRK

SEQ ID NO: 3874 - protein, 15 aa, Homo sapiens
KLWAYLTINQLLAER

SEQ ID NO: 3875 - protein, 8 aa, Homo sapiens
KMDAHPPR

SEQ ID NO: 3876 - protein, 9 aa, Homo sapiens
KMEILHPGK

SEQ ID NO: 3877 - protein, 8 aa, Homo sapiens
KMLLEEIK

SEQ ID NO: 3878 - protein, 15 aa, Homo sapiens
KMTSNFPVDLSDYPK

SEQ ID NO: 3879 - protein, 16 aa, Homo sapiens
KMYFDAVQAIETHLIR

SEQ ID NO: 3880 - protein, 22 aa, Homo sapiens
KMYYSAVDPTKDIFTGLIGPMK

SEQ ID NO: 3881 - protein, 7 aa, Homo sapiens
KNAEELK

SEQ ID NO: 3882 - protein, 9 aa, Homo sapiens
KNAEELKAR

SEQ ID NO: 3883 - protein, 8 aa, Homo sapiens
KNPIVFIR

SEQ ID NO: 3884 - protein, 19 aa, Homo sapiens
KNPLPSKETIEQEKQAGES

SEQ ID NO: 3885 - protein, 31 aa, Homo sapiens
KNPREDYLDVYVFGVGPLVNQVNINALASKK

SEQ ID NO: 3886 - protein, 39 aa, Homo sapiens
KNPREDYLDVYVFGVGPLVNQVNINALASKKDNEQHVFK

SEQ ID NO: 3887 - protein, 17 aa, Homo sapiens
KNQGILEFYGDDIALLK

SEQ ID NO: 3888 - protein, 9 aa, Homo sapiens
KNYVDWIMK

SEQ ID NO: 3889 - protein, 26 aa, Homo sapiens
KPDVSHGEMVSGFGPIYNYKDTIVFK

SEQ ID NO: 3890 - protein, 16 aa, Homo sapiens
KPLIGTVLAMDPDAAR

SEQ ID NO: 3891 - protein, 7 aa, Homo sapiens
KPLSIPK

SEQ ID NO: 3892 - protein, 14 aa, Homo sapiens
KPWLAYPHYKPPEK

SEQ ID NO: 3893 - protein, 7 aa, Homo sapiens
KPYNFLK

SEQ ID NO: 3894 - protein, 17 aa, Homo sapiens
KQIVAGVNYFLDVELGR

SEQ ID NO: 3895 - protein, 6 aa, Homo sapiens
KQNLER

SEQ ID NO: 3896 - protein, 18 aa, Homo sapiens
KSDVGFLPPFPTLDPEEK

SEQ ID NO: 3897 - protein, 19 aa, Homo sapiens
KSGGRTEHPFTVEEFVLPK

SEQ ID NO: 3898 - protein, 10 aa, Homo sapiens
KSISAALEHK

SEQ ID NO: 3899 - protein, 18 aa, Homo sapiens
KSLEDKTERELLESYIDG

SEQ ID NO: 3900 - protein, 19 aa, Homo sapiens
KSLEDKTERELLESYIDGR

SEQ ID NO: 3901 - protein, 8 aa, Homo sapiens
KSLSSMTR

SEQ ID NO: 3902 - protein, 9 aa, Homo sapiens
KSQLVYQSR

SEQ ID NO: 3903 - protein, 9 aa, Homo sapiens
KSQPMGLWR

SEQ ID NO: 3904 - protein, 7 aa, Homo sapiens
KSSIIIR

SEQ ID NO: 3905 - protein, 11 aa, Homo sapiens
KTDRFLVNLVK

SEQ ID NO: 3906 - protein, 12 aa, Homo sapiens
KTLLSNLEEAKK

SEQ ID NO: 3907 - protein, 18 aa, Homo sapiens
KTLQALEFHTVPFQLLAR

SEQ ID NO: 3908 - protein, 13 aa, Homo sapiens
KTSLEDFYLDEER

SEQ ID NO: 3909 - protein, 16 aa, Homo sapiens
KTSLEDFYLDEERTVR

SEQ ID NO: 3910 - protein, 20 aa, Homo sapiens
KVDYESQSTDTQNFSSESKR

SEQ ID NO: 3911 - protein, 7 aa, Homo sapiens
KVEFVLK

SEQ ID NO: 3912 - protein, 15 aa, Homo sapiens
KVEQAVETEPEPELR

SEQ ID NO: 3913 - protein, 13 aa, Homo sapiens
KVESELIKPINPR

SEQ ID NO: 3914 - protein, 10 aa, Homo sapiens
KVFEVHVRPK

SEQ ID NO: 3915 - protein, 12 aa, Homo sapiens
KVFSGDGKDFYR

SEQ ID NO: 3916 - protein, 7 aa, Homo sapiens
KVGSQYR

SEQ ID NO: 3917 - protein, 14 aa, Homo sapiens
KVMYTQYEDESFTK

SEQ ID NO: 3918 - protein, 14 aa, Homo sapiens
KVTEENKELANELR

SEQ ID NO: 3919 - protein, 13 aa, Homo sapiens
KVTYTSQEDLVEK

SEQ ID NO: 3920 - protein, 14 aa, Homo sapiens
KVTYTSQEDLVEKK

SEQ ID NO: 3921 - protein, 15 aa, Homo sapiens
KVVATTQMQAADARK

SEQ ID NO: 3922 - protein, 8 aa, Homo sapiens
KVVTVLVR

SEQ ID NO: 3923 - protein, 7 aa, Homo sapiens
KYAFELK

SEQ ID NO: 3924 - protein, 9 aa, Homo sapiens
KYAFELKEK

SEQ ID NO: 3925 - protein, 13 aa, Homo sapiens
KYFHHNSDFYIPK

SEQ ID NO: 3926 - protein, 9 aa, Homo sapiens
KYFIDFVAR

SEQ ID NO: 3927 - protein, 7 aa, Homo sapiens
KYIPGTK

SEQ ID NO: 3928 - protein, 7 aa, Homo sapiens
KYNELLK

SEQ ID NO: 3929 - protein, 16 aa, Homo sapiens
KYNSQNQSNNQFVLYR

SEQ ID NO: 3930 - protein, 13 aa, Homo sapiens
KYPVAHFIDQTLK

SEQ ID NO: 3931 - protein, 17 aa, Homo sapiens
KYTPEQVAMATVTALHR

SEQ ID NO: 3932 - protein, 21 aa, Homo sapiens
KYTYNYEAESSSGVPGTADSR

SEQ ID NO: 3933 - protein, 10 aa, Homo sapiens
KYVLPNFEVK

SEQ ID NO: 3934 - protein, 11 aa, Homo sapiens
KYWGVASFLQK

SEQ ID NO: 3935 - protein, 14 aa, Homo sapiens
LAAAVSNFGYDLYR

SEQ ID NO: 3936 - protein, 15 aa, Homo sapiens
LAARLEALKENGGAR

SEQ ID NO: 3937 - protein, 22 aa, Homo sapiens
LADDLYRYDVDTQMWTILKDSR

SEQ ID NO: 3938 - protein, 17 aa, Homo sapiens
LADGGATNQGRVEIFYR

SEQ ID NO: 3939 - protein, 11 aa, Homo sapiens
LAEGFPLPLLK

SEQ ID NO: 3940 - protein, 14 aa, Homo sapiens
LAELPADALGPLQR

SEQ ID NO: 3941 - protein, 7 aa, Homo sapiens
LAEQAER

SEQ ID NO: 3942 - protein, 7 aa, Homo sapiens
LAEYHAK

SEQ ID NO: 3943 - protein, 13 aa, Homo sapiens
LAGAPSEDPQFPK

SEQ ID NO: 3944 - protein, 24 aa, Homo sapiens
LAGYLHTLVQNLVNNGYVRDETVR

SEQ ID NO: 3945 - protein, 14 aa, Homo sapiens
LAKDSEKLKEEIGK

SEQ ID NO: 3946 - protein, 20 aa, Homo sapiens
LAKDSEKLKEEIGKELEELR

SEQ ID NO: 3947 - protein, 10 aa, Homo sapiens
LALDNGGLAR

SEQ ID NO: 3948 - protein, 18 aa, Homo sapiens
LALENYITALQAVPPRPR

SEQ ID NO: 3949 - protein, 24 aa, Homo sapiens
LAPDGSTVAVEPLLAGLEAGLQGR

SEQ ID NO: 3950 - protein, 9 aa, Homo sapiens
LAPLAEDVR

SEQ ID NO: 3951 - protein, 12 aa, Homo sapiens
LAPLAEDVRGNL

SEQ ID NO: 3952 - protein, 13 aa, Homo sapiens
LAPLAEDVRGNLR

SEQ ID NO: 3953 - protein, 21 aa, Homo sapiens
LAPLAEDVRGNLRGNTEGLQK

SEQ ID NO: 3954 - protein, 8 aa, Homo sapiens
LASAYGAR

SEQ ID NO: 3955 - protein, 11 aa, Homo sapiens
LASLFPALFSR

SEQ ID NO: 3956 - protein, 17 aa, Homo sapiens
LASPGFPGEYANDQERR

SEQ ID NO: 3957 - protein, 17 aa, Homo sapiens
LASRPYTFHSHGITYYK

SEQ ID NO: 3958 - protein, 9 aa, Homo sapiens
LAVSQVVHK

SEQ ID NO: 3959 - protein, 9 aa, Homo sapiens
LAVYQAGAR

SEQ ID NO: 3960 - protein, 13 aa, Homo sapiens
LAWYQQKPGQAPR

SEQ ID NO: 3961 - protein, 16 aa, Homo sapiens
LAYLQPALFSGLAELR

SEQ ID NO: 3962 - protein, 14 aa, Homo sapiens
LAYQDKGVLHNEVK

SEQ ID NO: 3963 - protein, 22 aa, Homo sapiens
LDAHKVLSALQAVQGLLVAQGR

SEQ ID NO: 3964 - protein, 18 aa, Homo sapiens
LDDDLEHQGGHVLDHGHK

SEQ ID NO: 3965 - protein, 19 aa, Homo sapiens
LDDDLEHQGGHVLDHGHKH

SEQ ID NO: 3966 - protein, 20 aa, Homo sapiens
LDDDLEHQGGHVLDHGHKHK

SEQ ID NO: 3967 - protein, 12 aa, Homo sapiens
LDDGRWHQVEVK

SEQ ID NO: 3968 - protein, 20 aa, Homo sapiens
LDDLRAEDHFSVIDFNQNIR

SEQ ID NO: 3969 - protein, 14 aa, Homo sapiens
LDELRDEGKASSAK

SEQ ID NO: 3970 - protein, 11 aa, Homo sapiens
LDFREIQIYKK

SEQ ID NO: 3971 - protein, 11 aa, Homo sapiens
LDGEFWLGLEK

SEQ ID NO: 3972 - protein, 11 aa, Homo sapiens
LDGKFSVVYAK

SEQ ID NO: 3973 - protein, 15 aa, Homo sapiens
LDLQEINNWVQAQMK

SEQ ID NO: 3974 - protein, 18 aa, Homo sapiens
LDPVSLQTLQTWNTSYPK

SEQ ID NO: 3975 - protein, 10 aa, Homo sapiens
LDRFTEDAKR

SEQ ID NO: 3976 - protein, 20 aa, Homo sapiens
LDRQDPPSVVVTSHQAPGEK

SEQ ID NO: 3977 - protein, 8 aa, Homo sapiens
LDTEDKLR

SEQ ID NO: 3978 - protein, 12 aa, Homo sapiens
LDTLAQEVALLK

SEQ ID NO: 3979 - protein, 11 aa, Homo sapiens
LEALKENGGAR

SEQ ID NO: 3980 - protein, 14 aa, Homo sapiens
LEALPNSLLAPLGR

SEQ ID NO: 3981 - protein, 14 aa, Homo sapiens
LEDMEQALSPSVFK

SEQ ID NO: 3982 - protein, 11 aa, Homo sapiens
LEGNKLQVLGK

SEQ ID NO: 3983 - protein, 11 aa, Homo sapiens
LELHVDGPPPR

SEQ ID NO: 3984 - protein, 15 aa, Homo sapiens
LELHVDGPPPRPQLR

SEQ ID NO: 3985 - protein, 9 aa, Homo sapiens
LELSVDGAK

SEQ ID NO: 3986 - protein, 7 aa, Homo sapiens
LELTGPK

SEQ ID NO: 3987 - protein, 40 aa, Homo sapiens; identical to SEQ ID NO: 397

SEQ ID NO: 3988 - protein, 9 aa, Homo sapiens
LEPYADQLR

SEQ ID NO: 3989 - protein, 10 aa, Homo sapiens
LETPDFQLFK

SEQ ID NO: 3990 - protein, 9 aa, Homo sapiens
LFAYPDTHR

SEQ ID NO: 3991 - protein, 10 aa, Homo sapiens
LFDEINPETK

SEQ ID NO: 3992 - protein, 17 aa, Homo sapiens
LFDSDPITVTVPVEVSR

SEQ ID NO: 3993 - protein, 7 aa, Homo sapiens
LFGPDLK

SEQ ID NO: 3994 - protein, 22 aa, Homo sapiens
LFHTNFYDTVGTIQLINDHVKK

SEQ ID NO: 3995 - protein, 15 aa, Homo sapiens
LFQGLGKLEYLLLSR

SEQ ID NO: 3996 - protein, 9 aa, Homo sapiens
LFQPLTHLK

SEQ ID NO: 3997 - protein, 7 aa, Homo sapiens
LFWEPMK

SEQ ID NO: 3998 - protein, 12 aa, Homo sapiens
LFWEPMKVHDIR

SEQ ID NO: 3999 - protein, 20 aa, Homo sapiens
LGAHQEVNLEPHVQEIEVSR

SEQ ID NO: 4000 - protein, 20 aa, Homo sapiens
LGEHNIEVLEGNEQFINAAK

SEQ ID NO: 4001 - protein, 9 aa, Homo sapiens
LGEPIPISK

SEQ ID NO: 4002 - protein, 13 aa, Homo sapiens
LGEVDHYQLALGK

SEQ ID NO: 4003 - protein, 13 aa, Homo sapiens
LGEVNTYAGDLQK

SEQ ID NO: 4004 - protein, 14 aa, Homo sapiens
LGEVNTYAGDLQKK

SEQ ID NO: 4005 - protein, 7 aa, Homo sapiens
LGEYDLR

SEQ ID NO: 4006 - protein, 9 aa, Homo sapiens
LGFTDLFSK

SEQ ID NO: 4007 - protein, 14 aa, Homo sapiens
LGGHLDQQVEEFRR

SEQ ID NO: 4008 - protein, 12 aa, Homo sapiens
LGGLLFPASNLR

SEQ ID NO: 4009 - protein, 10 aa, Homo sapiens
LGHLDLSGNR

SEQ ID NO: 4010 - protein, 11 aa, Homo sapiens
LGHLLHIRDEK

SEQ ID NO: 4011 - protein, 12 aa, Homo sapiens
LGHLLHIRDEKK

SEQ ID NO: 4012 - protein, 15 aa, Homo sapiens
LGNFPWQAFTSIHGR

SEQ ID NO: 4013 - protein, 8 aa, Homo sapiens
LGNHPVHR

SEQ ID NO: 4014 - protein, 13 aa, Homo sapiens
LGNQEPGGQTALK

SEQ ID NO: 4015 - protein, 7 aa, Homo sapiens
LGPEAFR

SEQ ID NO: 4016 - protein, 13 aa, Homo sapiens
LGPHAGDVEGHLS

SEQ ID NO: 4017 - protein, 17 aa, Homo sapiens
LGPHAGDVEGHLSFLEK

SEQ ID NO: 4018 - protein, 20 aa, Homo sapiens
LGPHAGDVEGHLSFLEKDLR

SEQ ID NO: 4019 - protein, 31 aa, Homo sapiens
LGPHAGDVEGHLSFLEKDLRDKVNSFFSTFK

SEQ ID NO: 4020 - protein, 33 aa, Homo sapiens
LGPHAGDVEGHLSFLEKDLRDKVNSFFSTFKEK

SEQ ID NO: 4021 - protein, 8 aa, Homo sapiens
LGPLSYSK

SEQ ID NO: 4022 - protein, 9 aa, Homo sapiens
LGPLVEQGR

SEQ ID NO: 4023 - protein, 14 aa, Homo sapiens
LGPQLHADVGDKVK

SEQ ID NO: 4024 - protein, 10 aa, Homo sapiens
LGQYASPTAK

SEQ ID NO: 4025 - protein, 11 aa, Homo sapiens
LGQYASPTAKR

SEQ ID NO: 4026 - protein, 10 aa, Homo sapiens
LGSEDKVLGR

SEQ ID NO: 4027 - protein, 7 aa, Homo sapiens
LGSYEHR

SEQ ID NO: 4028 - protein, 10 aa, Homo sapiens
LGVIEDHSNR

SEQ ID NO: 4029 - protein, 13 aa, Homo sapiens
LGVRPSQGGEAPR

SEQ ID NO: 4030 - protein, 9 aa, Homo sapiens
LGVYELLLK

SEQ ID NO: 4031 - protein, 14 aa, Homo sapiens
LGVYEVEDQITAVR

SEQ ID NO: 4032 - protein, 35 aa, Homo sapiens
LGWAMTSADLNQDGHGDLVVGAPGYSRPGHIHIGR

SEQ ID NO: 4033 - protein, 37 aa, Homo sapiens
LHDNQNGWSGDSAPVELILSDETLPAPEFSPEPESGR

SEQ ID NO: 4034 - protein, 9 aa, Homo sapiens
LHDRNTYEK

SEQ ID NO: 4035 - protein, 18 aa, Homo sapiens
LHEAFSPVSYQHDLALLR

SEQ ID NO: 4036 - protein, 7 aa, Homo sapiens
LHIMAGR

SEQ ID NO: 4037 - protein, 9 aa, Homo sapiens
LHKPGVYTR

SEQ ID NO: 4038 - protein, 7 aa, Homo sapiens
LHLEGNK

SEQ ID NO: 4039 - protein, 13 aa, Homo sapiens
LHLEGNKLQVLGK

SEQ ID NO: 4040 - protein, 23 aa, Homo sapiens
LHLEGNKLQVLGKDLLLPQPDLR

SEQ ID NO: 4041 - protein, 26 aa, Homo sapiens
LHLETDSLALVALGALDTALYAAGSK

SEQ ID NO: 4042 - protein, 11 aa, Homo sapiens
LIASMSSDSLR

SEQ ID NO: 4043 - protein, 20 aa, Homo sapiens
LIDQYGTHYLQSGSLGGEYR

SEQ ID NO: 4044 - protein, 9 aa, Homo sapiens
LIDVISMYR

SEQ ID NO: 4045 - protein, 7 aa, Homo sapiens
LIGDAAK

SEQ ID NO: 4046 - protein, 10 aa, Homo sapiens
LILVDYILFK

SEQ ID NO: 4047 - protein, 7 aa, Homo sapiens
LINDYVK

SEQ ID NO: 4048 - protein, 18 aa, Homo sapiens
LIRDVWGIEGPIDAAFTR

SEQ ID NO: 4049 - protein, 19 aa, Homo sapiens
LISVDTEHSNIYLQNGPDR

SEQ ID NO: 4050 - protein, 8 aa, Homo sapiens
LKATQVSK

SEQ ID NO: 4051 - protein, 11 aa, Homo sapiens
LKDDEVAQLKK

SEQ ID NO: 4052 - protein, 6 aa, Homo sapiens
LKDPVK

SEQ ID NO: 4053 - protein, 11 aa, Homo sapiens
LKEDAVSAAFK

SEQ ID NO: 4054 - protein, 13 aa, Homo sapiens
LKEEIGKELEELR

SEQ ID NO: 4055 - protein, 15 aa, Homo sapiens
LKEEIGKELEELRAR

SEQ ID NO: 4056 - protein, 11 aa, Homo sapiens
LKEFGNTLEDK

SEQ ID NO: 4057 - protein, 12 aa, Homo sapiens
LKEGMLSIMSYR

SEQ ID NO: 4058 - protein, 10 aa, Homo sapiens
LKELTLEDLK

SEQ ID NO: 4059 - protein, 17 aa, Homo sapiens
LKHELTDEELQSLFTNF

SEQ ID NO: 4060 - protein, 23 aa, Homo sapiens
LKHELTDEELQSLFTNFANVVDK

SEQ ID NO: 4061 - protein, 9 aa, Homo sapiens
LKHSLVLHK

SEQ ID NO: 4062 - protein, 27 aa, Homo sapiens
LKKTETQEKNPLPSKETIEQEKQAGES

SEQ ID NO: 4063 - protein, 11 aa, Homo sapiens
LKLSYEGEVTK

SEQ ID NO: 4064 - protein, 11 aa, Homo sapiens
LKMLEVPYVDR

SEQ ID NO: 4065 - protein, 27 aa, Homo sapiens
LKNIPTVNENLENYYLEVNQLEKFDIK

SEQ ID NO: 4066 - protein, 12 aa, Homo sapiens
LKQNDFNSVEEK

SEQ ID NO: 4067 - protein, 13 aa, Homo sapiens
LKQNDFNSVEEKK

SEQ ID NO: 4068 - protein, 14 aa, Homo sapiens
LKSWFEPLVEDMQR

SEQ ID NO: 4069 - protein, 8 aa, Homo sapiens
LKTPITFR

SEQ ID NO: 4070 - protein, 14 aa, Homo sapiens
LLDNWDSVTSTFSK

SEQ ID NO: 4071 - protein, 10 aa, Homo sapiens
LLDSLPSDTR

SEQ ID NO: 4072 - protein, 8 aa, Homo sapiens
LLELTGPK

SEQ ID NO: 4073 - protein, 8 aa, Homo sapiens
LLEVPEGR

SEQ ID NO: 4074 - protein, 14 aa, Homo sapiens
LLGEVDHYQLALGK

SEQ ID NO: 4075 - protein, 17 aa, Homo sapiens
LLGLSLAGKDQVETALK

SEQ ID NO: 4076 - protein, 13 aa, Homo sapiens
LLGMETMAWQEIR

SEQ ID NO: 4077 - protein, 9 aa, Homo sapiens
LLIGTVFHK

SEQ ID NO: 4078 - protein, 16 aa, Homo sapiens
LLIYDASSLESGVPSR

SEQ ID NO: 4079 - protein, 9 aa, Homo sapiens
LLIYGASSR

SEQ ID NO: 4080 - protein, 9 aa, Homo sapiens
LLIYWASTR

SEQ ID NO: 4081 - protein, 19 aa, Homo sapiens
LLLFSDGNSQGATPAAIEK

SEQ ID NO: 4082 - protein, 26 aa, Homo sapiens
LLLFSPSVVHLGVPLSVGVQLQDVPR

SEQ ID NO: 4083 - protein, 39 aa, Homo sapiens
LLLPGIYTVSATAPGYDPETVTVTVGPAEPTLVNFHLKR

SEQ ID NO: 4084 - protein, 37 aa, Homo sapiens
LLLRDTDRFSSHVGGTLGQFYQEVLWGSPAASDDGRR

SEQ ID NO: 4085 - protein, 13 aa, Homo sapiens
LLNHYQAVPNLHK

SEQ ID NO: 4086 - protein, 19 aa, Homo sapiens
LLPAFHTPSGIPWALLNMK

SEQ ID NO: 4087 - protein, 25 aa, Homo sapiens
LLPAQLPAEKEVGPPLPQEAVPLQK

SEQ ID NO: 4088 - protein, 11 aa, Homo sapiens
LLPHANEVSQK

SEQ ID NO: 4089 - protein, 12 aa, Homo sapiens
LLRPDYALLGHR

SEQ ID NO: 4090 - protein, 17 aa, Homo sapiens
LLSDPEQGVEVTGQYER

SEQ ID NO: 4091 - protein, 15 aa, Homo sapiens
LLSGGNTLHLVSTTK

SEQ ID NO: 4092 - protein, 13 aa, Homo sapiens
LLSGPYFWSLPSR

SEQ ID NO: 4093 - protein, 14 aa, Homo sapiens
LMALREPAAQAPVK

SEQ ID NO: 4094 - protein, 7 aa, Homo sapiens
LMEDLDR

SEQ ID NO: 4095 - protein, 17 aa, Homo sapiens
LMIIVPTDTQNIFFMSK

SEQ ID NO: 4096 - protein, 8 aa, Homo sapiens
LMNHYINK

SEQ ID NO: 4097 - protein, 11 aa, Homo sapiens
LMNHYINKETR

SEQ ID NO: 4098 - protein, 10 aa, Homo sapiens
LMVELHNLYR

SEQ ID NO: 4099 - protein, 8 aa, Homo sapiens
LNEREVVK

SEQ ID NO: 4100 - protein, 13 aa, Homo sapiens
LNHQLEGLTFQMK

SEQ ID NO: 4101 - protein, 14 aa, Homo sapiens
LNHQLEGLTFQMKK

SEQ ID NO: 4102 - protein, 6 aa, Homo sapiens
LNINLK

SEQ ID NO: 4103 - protein, 12 aa, Homo sapiens
LNMGITDLQGLR

SEQ ID NO: 4104 - protein, 10 aa, Homo sapiens
LNNGEITQHR

SEQ ID NO: 4105 - protein, 11 aa, Homo sapiens
LNNGEITQHRK

SEQ ID NO: 4106 - protein, 6 aa, Homo sapiens
LNNQLK

SEQ ID NO: 4107 - protein, 11 aa, Homo sapiens
LNRVNDAQEYR

SEQ ID NO: 4108 - protein, 12 aa, Homo sapiens
LNRVNDAQEYRR

SEQ ID NO: 4109 - protein, 16 aa, Homo sapiens
LNWEAPPGAFDSFLLR

SEQ ID NO: 4110 - protein, 9 aa, Homo sapiens
LPAKDVYER

SEQ ID NO: 4111 - protein, 11 aa, Homo sapiens
LPASHATWMGK

SEQ ID NO: 4112 - protein, 7 aa, Homo sapiens
LPAVDEK

SEQ ID NO: 4113 - protein, 6 aa, Homo sapiens
LPEISR

SEQ ID NO: 4114 - protein, 10 aa, Homo sapiens
LPHANEVSQK

SEQ ID NO: 4115 - protein, 15 aa, Homo sapiens
LPLEYSYGEYRDLFR

SEQ ID NO: 4116 - protein, 23 aa, Homo sapiens
LPLLMDSVIQALAELEQKVPAAK

SEQ ID NO: 4117 - protein, 6 aa, Homo sapiens
LPMSVR

SEQ ID NO: 4118 - protein, 23 aa, Homo sapiens
LPNLLQLHLEHNNLEEFPFPLPK

SEQ ID NO: 4119 - protein, 9 aa, Homo sapiens
LPNNVLQEK

SEQ ID NO: 4120 - protein, 11 aa, Homo sapiens
LPPNVVEESAR

SEQ ID NO: 4121 - protein, 18 aa, Homo sapiens
LPSGLPVSLLTLYLDNNK

SEQ ID NO: 4122 - protein, 28 aa, Homo sapiens
LPSGLPVSLLTLYLDNNKISNIPDEYFK

SEQ ID NO: 4123 - protein, 10 aa, Homo sapiens
LPTDSELAPR

SEQ ID NO: 4124 - protein, 8 aa, Homo sapiens
LPVAPLRK

SEQ ID NO: 4125 - protein, 9 aa, Homo sapiens
LPVSKPEIR

SEQ ID NO: 4126 - protein, 19 aa, Homo sapiens
LPYTIITTPPLKDFSLWEK

SEQ ID NO: 4127 - protein, 9 aa, Homo sapiens
LQAEAFQAR

SEQ ID NO: 4128 - protein, 10 aa, Homo sapiens
LQALKDTANR

SEQ ID NO: 4129 - protein, 10 aa, Homo sapiens
LQAVTDDHIR

SEQ ID NO: 4130 - protein, 9 aa, Homo sapiens
LQDEDLGFL

SEQ ID NO: 4131 - protein, 15 aa, Homo sapiens
LQDVFLLPDPSGQWR

SEQ ID NO: 4132 - protein, 26 aa, Homo sapiens
LQELHLSSNGLESLSPEFLRPVPQLR

SEQ ID NO: 4133 - protein, 10 aa, Homo sapiens
LQGTLPVEAR

SEQ ID NO: 4134 - protein, 16 aa, Homo sapiens
LQSAHPGEHLAQGASR

SEQ ID NO: 4135 - protein, 12 aa, Homo sapiens
LQSLFDSPDFSK

SEQ ID NO: 4136 - protein, 19 aa, Homo sapiens
LQSLFDSPDFSKITGKPIK

SEQ ID NO: 4137 - protein, 6 aa, Homo sapiens
LQVIFK

SEQ ID NO: 4138 - protein, 16 aa, Homo sapiens
LQVLGKDLLLPQPDLR

SEQ ID NO: 4139 - protein, 37 aa, Homo sapiens
LREQLGPVTQEFWDNLEKETEGLRQEMSKDLEEVKAK

SEQ ID NO: 4140 - protein, 42 aa, Homo sapiens; identical to SEQ ID NO: 89

SEQ ID NO: 4141 - protein, 11 aa, Homo sapiens
LRPDYALLGHR

SEQ ID NO: 4142 - protein, 11 aa, Homo sapiens
LRQVSGPLTSK

SEQ ID NO: 4143 - protein, 13 aa, Homo sapiens
LRSDENEQHLGVK

SEQ ID NO: 4144 - protein, 6 aa, Homo sapiens
LSDLLK

SEQ ID NO: 4145 - protein, 17 aa, Homo sapiens
LSEDYGVLKTDEGIAYR

SEQ ID NO: 4146 - protein, 15 aa, Homo sapiens
LSEKHEGSFIQGAEK

SEQ ID NO: 4147 - protein, 11 aa, Homo sapiens
LSFVKVDSHFR

SEQ ID NO: 4148 - protein, 10 aa, Homo sapiens
LSFYYLIMAK

SEQ ID NO: 4149 - protein, 13 aa, Homo sapiens
LSGALHVYSLGSD

SEQ ID NO: 4150 - protein, 8 aa, Homo sapiens
LSGITGAR

SEQ ID NO: 4151 - protein, 13 aa, Homo sapiens
LSGNVLSYTFQVK

SEQ ID NO: 4152 - protein, 12 aa, Homo sapiens
LSHNAIASLRPR

SEQ ID NO: 4153 - protein, 11 aa, Homo sapiens
LSKELQAAQAR

SEQ ID NO: 4154 - protein, 12 aa, Homo sapiens
LSLEIEQLELQR

SEQ ID NO: 4155 - protein, 12 aa, Homo sapiens
LSLLDRFTEDAK

SEQ ID NO: 4156 - protein, 13 aa, Homo sapiens
LSLLDRFTEDAKR

SEQ ID NO: 4157 - protein, 9 aa, Homo sapiens
LSMDGSPTR

SEQ ID NO: 4158 - protein, 10 aa, Homo sapiens
LSMDIDVSYK

SEQ ID NO: 4159 - protein, 11 aa, Homo sapiens
LSNENHGIAQR

SEQ ID NO: 4160 - protein, 16 aa, Homo sapiens
LSNNALSGLPQGVFGK

SEQ ID NO: 4161 - protein, 11 aa, Homo sapiens
LSPIYNLVPVK

SEQ ID NO: 4162 - protein, 11 aa, Homo sapiens
LSPLGEEMRDR

SEQ ID NO: 4163 - protein, 11 aa, Homo sapiens
LSQEDPDYGIR

SEQ ID NO: 4164 - protein, 15 aa, Homo sapiens
LSQLSVTDVTTSSLR

SEQ ID NO: 4165 - protein, 13 aa, Homo sapiens
LSSGLVTAALYGR

SEQ ID NO: 4166 - protein, 10 aa, Homo sapiens
LSSPAVITDK

SEQ ID NO: 4167 - protein, 15 aa, Homo sapiens
LSVAVLREDFQIQPR

SEQ ID NO: 4168 - protein, 9 aa, Homo sapiens
LSYEGEVTK

SEQ ID NO: 4169 - protein, 12 aa, Homo sapiens
LTEVLLGHNSWR

SEQ ID NO: 4170 - protein, 18 aa, Homo sapiens
LTGSSGFVTDGPGNYKYK

SEQ ID NO: 4171 - protein, 9 aa, Homo sapiens
LTIFKTELR

SEQ ID NO: 4172 - protein, 10 aa, Homo sapiens
LTISEQNIQR

SEQ ID NO: 4173 - protein, 9 aa, Homo sapiens
LTLDIQNKK

SEQ ID NO: 4174 - protein, 23 aa, Homo sapiens
LTLLAPLNSVFKDGTPPIDAHTR

SEQ ID NO: 4175 - protein, 37 aa, Homo sapiens; identical to SEQ ID NO: 1915

SEQ ID NO: 4176 - protein, 10 aa, Homo sapiens
LTLTPWVGLR

SEQ ID NO: 4177 - protein, 11 aa, Homo sapiens
LTLTPWVGLRK

SEQ ID NO: 4178 - protein, 13 aa, Homo sapiens
LTPEHVFIHPGWK

SEQ ID NO: 4179 - protein, 9 aa, Homo sapiens
LTPLYELVK

SEQ ID NO: 4180 - protein, 9 aa, Homo sapiens
LTPYADEFK

SEQ ID NO: 4181 - protein, 11 aa, Homo sapiens
LTPYADEFKVK

SEQ ID NO: 4182 - protein, 19 aa, Homo sapiens
LTPYADEFKVKIDQTVEEL

SEQ ID NO: 4183 - protein, 21 aa, Homo sapiens
LTPYADEFKVKIDQTVEELRR

SEQ ID NO: 4184 - protein, 7 aa, Homo sapiens
LTQVEHR

SEQ ID NO: 4185 - protein, 10 aa, Homo sapiens
LTSLPLGALR

SEQ ID NO: 4186 - protein, 7 aa, Homo sapiens
LTSLSDR

SEQ ID NO: 4187 - protein, 30 aa, Homo sapiens; identical to SEQ ID NO: 98

SEQ ID NO: 4188 - protein, 25 aa, Homo sapiens
LTVAAPPSGGPGFLSIERPDSRPPR

SEQ ID NO: 4189 - protein, 7 aa, Homo sapiens
LTVDKSR

SEQ ID NO: 4190 - protein, 18 aa, Homo sapiens
LTVGAAQVPAQLLVGALR

SEQ ID NO: 4191 - protein, 8 aa, Homo sapiens
LTVGLTRR

SEQ ID NO: 4192 - protein, 8 aa, Homo sapiens
LTVLSQPK

SEQ ID NO: 4193 - protein, 12 aa, Homo sapiens
LTYNHGGITGSR

SEQ ID NO: 4194 - protein, 10 aa, Homo sapiens
LVDEDMNSFK

SEQ ID NO: 4195 - protein, 14 aa, Homo sapiens
LVDEDMNSFKADVK

SEQ ID NO: 4196 - protein, 12 aa, Homo sapiens
LVDGKGVPIPNK

SEQ ID NO: 4197 - protein, 13 aa, Homo sapiens
LVDYLDVGFDTTR

SEQ ID NO: 4198 - protein, 17 aa, Homo sapiens
LVGGPMDASVEEEGVRR

SEQ ID NO: 4199 - protein, 13 aa, Homo sapiens
LVHVEEPHTETVR

SEQ ID NO: 4200 - protein, 11 aa, Homo sapiens
LVKDMVEYKDR

SEQ ID NO: 4201 - protein, 13 aa, Homo sapiens
LVLNTKEELANER

SEQ ID NO: 4202 - protein, 12 aa, Homo sapiens
LVNGQSHISLSK

SEQ ID NO: 4203 - protein, 33 aa, Homo sapiens; identical to SEQ ID NO: 137

SEQ ID NO: 4204 - protein, 11 aa, Homo sapiens
LVNIYDSMPLR

SEQ ID NO: 4205 - protein, 11 aa, Homo sapiens
LVPFATELHER

SEQ ID NO: 4206 - protein, 16 aa, Homo sapiens
LVPPMEEDYPQFGSPK

SEQ ID NO: 4207 - protein, 9 aa, Homo sapiens
LVQQMEQLR

SEQ ID NO: 4208 - protein, 22 aa, Homo sapiens
LVRPEVDVMCTAFHDNEETFLK

SEQ ID NO: 4209 - protein, 8 aa, Homo sapiens
LVVLNNLK

SEQ ID NO: 4210 - protein, 9 aa, Homo sapiens
LVWEEAMSR

SEQ ID NO: 4211 - protein, 14 aa, Homo sapiens
LVYREYTDASFTNR

SEQ ID NO: 4212 - protein, 15 aa, Homo sapiens
LVYREYTDASFTNRK

SEQ ID NO: 4213 - protein, 13 aa, Homo sapiens
LWAYLTIEQLLEK

SEQ ID NO: 4214 - protein, 14 aa, Homo sapiens
LWAYLTIEQLLEKR

SEQ ID NO: 4215 - protein, 14 aa, Homo sapiens
LWAYLTINQLLAER

SEQ ID NO: 4216 - protein, 13 aa, Homo sapiens
LWAYLTIQELLAK

SEQ ID NO: 4217 - protein, 9 aa, Homo sapiens
LYGRAPQLR

SEQ ID NO: 4218 - protein, 21 aa, Homo sapiens
LYGSAGPPPTGEEDTAEKDEL

SEQ ID NO: 4219 - protein, 18 aa, Homo sapiens
LYGSEAFATDFQDSAAAK

SEQ ID NO: 4220 - protein, 19 aa, Homo sapiens
LYGSEAFATDFQDSAAAKK

SEQ ID NO: 4221 - protein, 10 aa, Homo sapiens
LYLQMSTHGK

SEQ ID NO: 4222 - protein, 11 aa, Homo sapiens
LYLQYTDETFR

SEQ ID NO: 4223 - protein, 15 aa, Homo sapiens
LYLVQGTQVYVFLTK

SEQ ID NO: 4224 - protein, 16 aa, Homo sapiens
LYPIANGNNQSPVDIK

SEQ ID NO: 4225 - protein, 8 aa, Homo sapiens
LYPTYSTK

SEQ ID NO: 4226 - protein, 15 aa, Homo sapiens
MAAQHGMDDDGTGQK

SEQ ID NO: 4227 - protein, 17 aa, Homo sapiens
MADEAGSEADHEGTHST

SEQ ID NO: 4228 - protein, 19 aa, Homo sapiens
MADEAGSEADHEGTHSTKR

SEQ ID NO: 4229 - protein, 19 aa, Homo sapiens
MALEVYKLSLEIEQLELQR

SEQ ID NO: 4230 - protein, 9 aa, Homo sapiens
MATTMIQSK

SEQ ID NO: 4231 - protein, 7 aa, Homo sapiens
MDAHPPR

SEQ ID NO: 4232 - protein, 14 aa, Homo sapiens
MDAHPPRLFACSNK

SEQ ID NO: 4233 - protein, 19 aa, Homo sapiens
MDELRPLIPVLEEYKADAK

SEQ ID NO: 4234 - protein, 8 aa, Homo sapiens
MDILSYMR

SEQ ID NO: 4235 - protein, 15 aa, Homo sapiens
MDPNAAYVNMSNHHR

SEQ ID NO: 4236 - protein, 18 aa, Homo sapiens
MDYKGDATVFFILPNQGK

SEQ ID NO: 4237 - protein, 22 aa, Homo sapiens
MDYPKQTQVSVLPEGGETPLFK

SEQ ID NO: 4238 - protein, 15 aa, Homo sapiens
MEEVEAMLLPETLKR

SEQ ID NO: 4239 - protein, 7 aa, Homo sapiens
MEPFHFK

SEQ ID NO: 4240 - protein, 13 aa, Homo sapiens
MEWNKEAAANAQK

SEQ ID NO: 4241 - protein, 6 aa, Homo sapiens
MFEELK

SEQ ID NO: 4242 - protein, 42 aa, Homo sapiens
MFGNLQGLTMHVGDEVNWYLMGMGNEIDLHTVHFHGHSFQYK

SEQ ID NO: 4243 - protein, 21 aa, Homo sapiens
MFTTAPDQVDKEDEDFQESNK

SEQ ID NO: 4244 - protein, 21 aa, Homo sapiens
MGDHLALEDYLTTDLVETWLR

SEQ ID NO: 4245 - protein, 23 aa, Homo sapiens
MGIQHAYSENADFSGLTEDNGLK

SEQ ID NO: 4246 - protein, 30 aa, Homo sapiens; identical to SEQ ID NO: 2367

SEQ ID NO: 4247 - protein, 9 aa, Homo sapiens
MGLAFESTK

SEQ ID NO: 4248 - protein, 15 aa, Homo sapiens
MGNFPWQVFTNIHGR

SEQ ID NO: 4249 - protein, 15 aa, Homo sapiens
MGPKGEPGDPVNLLR

SEQ ID NO: 4250 - protein, 17 aa, Homo sapiens
MGVVSLGSPSGEVSHPR

SEQ ID NO: 4251 - protein, 7 aa, Homo sapiens
MHAINGR

SEQ ID NO: 4252 - protein, 11 aa, Homo sapiens
MHLYGLHEGQR

SEQ ID NO: 4253 - protein, 13 aa, Homo sapiens
MINLSVPDTIDER

SEQ ID NO: 4254 - protein, 12 aa, Homo sapiens
MKETAEAYLGKK

SEQ ID NO: 4255 - protein, 9 aa, Homo sapiens
MKQTVEAMK

SEQ ID NO: 4256 - protein, 12 aa, Homo sapiens
MKYWGVASFLQK

SEQ ID NO: 4257 - protein, 8 aa, Homo sapiens
MLENHVER

SEQ ID NO: 4258 - protein, 9 aa, Homo sapiens
MLEVPYVDR

SEQ ID NO: 4259 - protein, 16 aa, Homo sapiens
MLFDKNGNMAGISDQR

SEQ ID NO: 4260 - protein, 14 aa, Homo sapiens
MLTPEHVFIHPGWK

SEQ ID NO: 4261 - protein, 14 aa, Homo sapiens
MMALDREVQYLLNK

SEQ ID NO: 4262 - protein, 11 aa, Homo sapiens
MMAVAADTLQR

SEQ ID NO: 4263 - protein, 12 aa, Homo sapiens
MNFKQELNGNTK

SEQ ID NO: 4264 - protein, 9 aa, Homo sapiens
MNFRPGVLS

SEQ ID NO: 4265 - protein, 10 aa, Homo sapiens
MNFRPGVLSS

SEQ ID NO: 4266 - protein, 16 aa, Homo sapiens
MNIFQHLAFSDVDVAR

SEQ ID NO: 4267 - protein, 10 aa, Homo sapiens
MNTVIAALSR

SEQ ID NO: 4268 - protein, 12 aa, Homo sapiens
MPFDPQDTHQSR

SEQ ID NO: 4269 - protein, 26 aa, Homo sapiens
MPITYDNGFLFIHTDKPVYTPDQSVK

SEQ ID NO: 4270 - protein, 8 aa, Homo sapiens
MQAVTGWK

SEQ ID NO: 4271 - protein, 14 aa, Homo sapiens
MQKEITALAPSTMK

SEQ ID NO: 4272 - protein, 9 aa, Homo sapiens
MRDVVLFEK

SEQ ID NO: 4273 - protein, 15 aa, Homo sapiens
MREIEEVLTPEMLMR

SEQ ID NO: 4274 - protein, 19 aa, Homo sapiens
MRPSTDTITVMVENSHGLR

SEQ ID NO: 4275 - protein, 15 aa, Homo sapiens
MSAPAGSSHPAASAR

SEQ ID NO: 4276 - protein, 11 aa, Homo sapiens
MSAPNSGPHNR

SEQ ID NO: 4277 - protein, 19 aa, Homo sapiens
MSAQTHGLLGQFFQPFDFK

SEQ ID NO: 4278 - protein, 21 aa, Homo sapiens
MSAVEGICTSESPVIDHQGTK

SEQ ID NO: 4279 - protein, 7 aa, Homo sapiens
MSESGFK

SEQ ID NO: 4280 - protein, 17 aa, Homo sapiens
MSLDYGFVTPLTSMSIR

SEQ ID NO: 4281 - protein, 31 aa, Homo sapiens
MSLSSFSVNRPFLFFIFEDTTGLPLFVGSVR

SEQ ID NO: 4282 - protein, 16 aa, Homo sapiens
MSPPQLALNPSALLSR

SEQ ID NO: 4283 - protein, 14 aa, Homo sapiens
MSSINADFAFNLYR

SEQ ID NO: 4284 - protein, 12 aa, Homo sapiens
MTGLVDEAIDTK

SEQ ID NO: 4285 - protein, 16 aa, Homo sapiens
MVETTAYALLTSLNLK

SEQ ID NO: 4286 - protein, 26 aa, Homo sapiens
MVETTAYALLTSLNLKDINYVNPVIK

SEQ ID NO: 4287 - protein, 14 aa, Homo sapiens
MVGLEGSDKLTILR

SEQ ID NO: 4288 - protein, 15 aa, Homo sapiens
MVLLEQLFLDHNALR

SEQ ID NO: 4289 - protein, 13 aa, Homo sapiens
MVSGFIPLKPTVK

SEQ ID NO: 4290 - protein, 12 aa, Homo sapiens
MYLGYEYVTAIR

SEQ ID NO: 4291 - protein, 12 aa, Homo sapiens
MYQMDIQQELQR

SEQ ID NO: 4292 - protein, 10 aa, Homo sapiens
MYYSAVDPTK

SEQ ID NO: 4293 - protein, 21 aa, Homo sapiens
MYYSAVDPTKDIFTGLIGPMK

SEQ ID NO: 4294 - protein, 36 aa, Homo sapiens; identical to SEQ ID NO: 1097

SEQ ID NO: 4295 - protein, 10 aa, Homo sapiens
NADYSYSVWK

SEQ ID NO: 4296 - protein, 8 aa, Homo sapiens
NAEELKAR

SEQ ID NO: 4297 - protein, 13 aa, Homo sapiens
NAHGEEKENLTAR

SEQ ID NO: 4298 - protein, 35 aa, Homo sapiens
NAIGGKFPLYNLGFGNNLNYNFLENMALENHGFAR

SEQ ID NO: 4299 - protein, 10 aa, Homo sapiens
NALALFVLPK

SEQ ID NO: 4300 - protein, 39 aa, Homo sapiens
NALTGLPPGLFQASATLDTLVLKENQLEVLEVSWLHGLK

SEQ ID NO: 4301 - protein, 14 aa, Homo sapiens
NALWHTGNTPGQVR

SEQ ID NO: 4302 - protein, 9 aa, Homo sapiens
NAPTPQEFR

SEQ ID NO: 4303 - protein, 9 aa, Homo sapiens
NDDLKPAKR

SEQ ID NO: 4304 - protein, 8 aa, Homo sapiens
NDLISATK

SEQ ID NO: 4305 - protein, 8 aa, Homo sapiens
NDLLSATK

SEQ ID NO: 4306 - protein, 14 aa, Homo sapiens
NDLSPTTVMSEGAR

SEQ ID NO: 4307 - protein, 10 aa, Homo sapiens
NDTILEVWLR

SEQ ID NO: 4308 - protein, 20 aa, Homo sapiens
NEDKDPAFTALLTTQTQVQR

SEQ ID NO: 4309 - protein, 22 aa, Homo sapiens
NEDSLVFVQTDKSIYKPGQTVK

SEQ ID NO: 4310 - protein, 20 aa, Homo sapiens
NEEAVKKDNSVHWERPQKPK

SEQ ID NO: 4311 - protein, 15 aa, Homo sapiens
NEGTYYSPNYNPQSR

SEQ ID NO: 4312 - protein, 9 aa, Homo sapiens
NEINYEDHK

SEQ ID NO: 4313 - protein, 9 aa, Homo sapiens
NENHGIAQR

SEQ ID NO: 4314 - protein, 10 aa, Homo sapiens
NFDNDIALVR

SEQ ID NO: 4315 - protein, 10 aa, Homo sapiens
NFFNPPIISR

SEQ ID NO: 4316 - protein, 14 aa, Homo sapiens
NFGDLVSIQSESEK

SEQ ID NO: 4317 - protein, 7 aa, Homo sapiens
NFGYTLR

SEQ ID NO: 4318 - protein, 16 aa, Homo sapiens
NFMAIGFTDGSVTLNK

SEQ ID NO: 4319 - protein, 15 aa, Homo sapiens
NFRTEHYEEQIEAFK

SEQ ID NO: 4320 - protein, 8 aa, Homo sapiens
NGFYPATR

SEQ ID NO: 4321 - protein, 23 aa, Homo sapiens
NGLYADNDNDSTFTGFLLYHDTN

SEQ ID NO: 4322 - protein, 11 aa, Homo sapiens
NGNMAGISDQR

SEQ ID NO: 4323 - protein, 9 aa, Homo sapiens
NGQWSEPPK

SEQ ID NO: 4324 - protein, 16 aa, Homo sapiens
NGVAQEPVHLDSPAIK

SEQ ID NO: 4325 - protein, 28 aa, Homo sapiens
NGVAQEPVHLDSPAIKHQFLLTGDTQGR

SEQ ID NO: 4326 - protein, 11 aa, Homo sapiens
NHIIKDQLASK

SEQ ID NO: 4327 - protein, 10 aa, Homo sapiens
NHMQYEIVIK

SEQ ID NO: 4328 - protein, 13 aa, Homo sapiens
NHNALLASLTTQK

SEQ ID NO: 4329 - protein, 12 aa, Homo sapiens
NHQLEGLTFQMK

SEQ ID NO: 4330 - protein, 8 aa, Homo sapiens
NHQLIVTR

SEQ ID NO: 4331 - protein, 9 aa, Homo sapiens
NHVTLSQPK

SEQ ID NO: 4332 - protein, 10 aa, Homo sapiens
NIEKISMLEK

SEQ ID NO: 4333 - protein, 22 aa, Homo sapiens
NILDRQDPPSVVVTSHQAPGEK

SEQ ID NO: 4334 - protein, 23 aa, Homo sapiens
NILDRQDPPSVVVTSHQAPGEKK

SEQ ID NO: 4335 - protein, 16 aa, Homo sapiens
NILFVIDVSGSMWGVK

SEQ ID NO: 4336 - protein, 21 aa, Homo sapiens
NIPTVNENLENYYLEVNQLEK

SEQ ID NO: 4337 - protein, 25 aa, Homo sapiens
NIPTVNENLENYYLEVNQLEKFDIK

SEQ ID NO: 4338 - protein, 10 aa, Homo sapiens
NIQSLEVIGK

SEQ ID NO: 4339 - protein, 12 aa, Homo sapiens
NKDDEEFIESNK

SEQ ID NO: 4340 - protein, 10 aa, Homo sapiens
NKFDPSLTQR

SEQ ID NO: 4341 - protein, 12 aa, Homo sapiens
NKFNQVESDKLR

SEQ ID NO: 4342 - protein, 12 aa, Homo sapiens
NKKEFDHNSNIR

SEQ ID NO: 4343 - protein, 17 aa, Homo sapiens
NKPGVYTDVAYYLAWIR

SEQ ID NO: 4344 - protein, 9 aa, Homo sapiens
NLASRPYTF

SEQ ID NO: 4345 - protein, 12 aa, Homo sapiens
NLASRPYTFHSH

SEQ ID NO: 4346 - protein, 18 aa, Homo sapiens
NLASRPYTFHSHGITYYK

SEQ ID NO: 4347 - protein, 10 aa, Homo sapiens
NLAVSQVVHK

SEQ ID NO: 4348 - protein, 29 aa, Homo sapiens
NLAVSQVVHKAVLDVFEEGTEASAATAVK

SEQ ID NO: 4349 - protein, 40 aa, Homo sapiens
NLAVSQVVHKAVLDVFEEGTEASAATAVKITLLSALVETR

SEQ ID NO: 4350 - protein, 13 aa, Homo sapiens
NLDGISHAPNAVK

SEQ ID NO: 4351 - protein, 15 aa, Homo sapiens
NLIAAVAPGAFLGLK

SEQ ID NO: 4352 - protein, 22 aa, Homo sapiens
NLIAVLGEHDLSEHDGDEQSRR

SEQ ID NO: 4353 - protein, 8 aa, Homo sapiens
NLPEQVFR

SEQ ID NO: 4354 - protein, 17 aa, Homo sapiens
NLPSDSQDLGQHGLEED

SEQ ID NO: 4355 - protein, 19 aa, Homo sapiens
NLPSDSQDLGQHGLEEDFM

SEQ ID NO: 4356 - protein, 15 aa, Homo sapiens
NLQNNAEWVYQGAIR

SEQ ID NO: 4357 - protein, 16 aa, Homo sapiens
NLQPASEYTVSLVAIK

SEQ ID NO: 4358 - protein, 23 aa, Homo sapiens
NLQPASEYTVSLVAIKGNQESPK

SEQ ID NO: 4359 - protein, 7 aa, Homo sapiens
NLVTDLK

SEQ ID NO: 4360 - protein, 7 aa, Homo sapiens
NMATRPY

SEQ ID NO: 4361 - protein, 12 aa, Homo sapiens
NMATRPYSIHAH

SEQ ID NO: 4362 - protein, 35 aa, Homo sapiens
NMATRPYSIHAHGVQTESSTVTPTLPGETLTYVWK

SEQ ID NO: 4363 - protein, 39 aa, Homo sapiens
NMATRPYSIHAHGVQTESSTVTPTLPGETLTYVWKIPER

SEQ ID NO: 4364 - protein, 9 aa, Homo sapiens
NNALDFVTK

SEQ ID NO: 4365 - protein, 10 aa, Homo sapiens
NNANGVDLNR

SEQ ID NO: 4366 - protein, 12 aa, Homo sapiens
NNEEYLALIFEK

SEQ ID NO: 4367 - protein, 15 aa, Homo sapiens
NNEGTYYSPNYNPQS

SEQ ID NO: 4368 - protein, 16 aa, Homo sapiens
NNEGTYYSPNYNPQSR

SEQ ID NO: 4369 - protein, 21 aa, Homo sapiens
NNLELSTPLKIETISHEDLQR

SEQ ID NO: 4370 - protein, 10 aa, Homo sapiens
NNQIDHIDEK

SEQ ID NO: 4371 - protein, 11 aa, Homo sapiens
NNQKSEPLIGR

SEQ ID NO: 4372 - protein, 10 aa, Homo sapiens
NNRPSGIPDR

SEQ ID NO: 4373 - protein, 16 aa, Homo sapiens
NNRWEDILSDEVNVAR

SEQ ID NO: 4374 - protein, 9 aa, Homo sapiens
NPDNDIRPW

SEQ ID NO: 4375 - protein, 13 aa, Homo sapiens
NPLPSKETIEQEK

SEQ ID NO: 4376 - protein, 18 aa, Homo sapiens
NPLPSKETIEQEKQAGES

SEQ ID NO: 4377 - protein, 17 aa, Homo sapiens
NPLVWVHASPEHVVVTR

SEQ ID NO: 4378 - protein, 12 aa, Homo sapiens
NQEQVSPLTLLK

SEQ ID NO: 4379 - protein, 10 aa, Homo sapiens
NQFNDYTSKK

SEQ ID NO: 4380 - protein, 16 aa, Homo sapiens
NQGILEFYGDDIALLK

SEQ ID NO: 4381 - protein, 16 aa, Homo sapiens
NQLTSNPENTVFDAKR

SEQ ID NO: 4382 - protein, 11 aa, Homo sapiens
NQVNSGGVLLR

SEQ ID NO: 4383 - protein, 9 aa, Homo sapiens
NQVVIAAGR

SEQ ID NO: 4384 - protein, 15 aa, Homo sapiens
NQYDNDVTVWSPQGR

SEQ ID NO: 4385 - protein, 15 aa, Homo sapiens
NRDVVLTTTFVDDIK

SEQ ID NO: 4386 - protein, 21 aa, Homo sapiens
NREEDPSLLWQVFGSATGLAR

SEQ ID NO: 4387 - protein, 23 aa, Homo sapiens
NRIPESGGDNSVFDIFELTGAAR

SEQ ID NO: 4388 - protein, 16 aa, Homo sapiens
NRLAELPADALGPLQR

SEQ ID NO: 4389 - protein, 21 aa, Homo sapiens
NRPFLMIIVPTDTQNIFFMSK

SEQ ID NO: 4390 - protein, 14 aa, Homo sapiens
NSLWHTGDTSDQVR

SEQ ID NO: 4391 - protein, 11 aa, Homo sapiens
NSLYLQMNSLR

SEQ ID NO: 4392 - protein, 16 aa, Homo sapiens
NSPLDEENLTQENQDR

SEQ ID NO: 4393 - protein, 37 aa, Homo sapiens
NSPLDEENLTQENQDRGTHVDLGLASANVDFAFSLYK

SEQ ID NO: 4394 - protein, 14 aa, Homo sapiens
NSQNQSNNQFVLYR

SEQ ID NO: 4395 - protein, 12 aa, Homo sapiens
NSVIKVPMMNSK

SEQ ID NO: 4396 - protein, 6 aa, Homo sapiens
NTASLK

SEQ ID NO: 4397 - protein, 23 aa, Homo sapiens
NTEILTGSWSDQTYPEGTQAIYK

SEQ ID NO: 4398 - protein, 19 aa, Homo sapiens
NTEQEEGGEAVHEVEVVIK

SEQ ID NO: 4399 - protein, 22 aa, Homo sapiens
NTEQEEGGEAVHEVEVVIKHNR

SEQ ID NO: 4400 - protein, 18 aa, Homo sapiens
NTFAEVTGLSPGVTYYFK

SEQ ID NO: 4401 - protein, 11 aa, Homo sapiens
NTLYLQMNSLR

SEQ ID NO: 4402 - protein, 16 aa, Homo sapiens
NVAEGETKPDPDVTER

SEQ ID NO: 4403 - protein, 15 aa, Homo sapiens
NVAFVIDISGSMAGR

SEQ ID NO: 4404 - protein, 13 aa, Homo sapiens
NVALVSGDTENAK

SEQ ID NO: 4405 - protein, 15 aa, Homo sapiens
NVAQLQSSVDLSGSK

SEQ ID NO: 4406 - protein, 12 aa, Homo sapiens
NVDGVNYASITR

SEQ ID NO: 4407 - protein, 8 aa, Homo sapiens
NVEELKGR

SEQ ID NO: 4408 - protein, 7 aa, Homo sapiens
NVLPGAK

SEQ ID NO: 4409 - protein, 19 aa, Homo sapiens
NVLVTLYERDEDNNLLTEK

SEQ ID NO: 4410 - protein, 6 aa, Homo sapiens
NVNFQK

SEQ ID NO: 4411 - protein, 29 aa, Homo sapiens
NVPLPVIAELPPKVSVFVPPRDGFFGNPR

SEQ ID NO: 4412 - protein, 33 aa, Homo sapiens; identical to SEQ ID NO: 372

SEQ ID NO: 4413 - protein, 8 aa, Homo sapiens
NVVFVIDK

SEQ ID NO: 4414 - protein, 11 aa, Homo sapiens
NWMNSLGVNPR

SEQ ID NO: 4415 - protein, 19 aa, Homo sapiens
NWRDPDQTDGLGLSYLSSH

SEQ ID NO: 4416 - protein, 25 aa, Homo sapiens
NWRDPDQTDGLGLSYLSSHIANVER

SEQ ID NO: 4417 - protein, 20 aa, Homo sapiens
NYFDWISYHVGRPFISQYNV

SEQ ID NO: 4418 - protein, 15 aa, Homo sapiens
NYLAWYQQKPGQPPK

SEQ ID NO: 4419 - protein, 9 aa, Homo sapiens
NYNLVESLK

SEQ ID NO: 4420 - protein, 6 aa, Homo sapiens
NYQLYK

SEQ ID NO: 4421 - protein, 8 aa, Homo sapiens
NYVDWIMK

SEQ ID NO: 4422 - protein, 12 aa, Homo sapiens
PAINVAVHVFRK

SEQ ID NO: 4423 - protein, 18 aa, Homo sapiens
PALPAGTEDTAKEDAANR

SEQ ID NO: 4424 - protein, 19 aa, Homo sapiens
PALPAGTEDTAKEDAANRK

SEQ ID NO: 4425 - protein, 18 aa, Homo sapiens
PAPWLSMAPVSWITPGLK

SEQ ID NO: 4426 - protein, 9 aa, Homo sapiens
PASAENVNK

SEQ ID NO: 4427 - protein, 15 aa, Homo sapiens
PDEISILLLGVAHFK

SEQ ID NO: 4428 - protein, 7 aa, Homo sapiens
PDFQLFK

SEQ ID NO: 4429 - protein, 10 aa, Homo sapiens
PDISEPGTWK

SEQ ID NO: 4430 - protein, 16 aa, Homo sapiens
PDTFEGHFDGVPVISK

SEQ ID NO: 4431 - protein, 14 aa, Homo sapiens
PEANFPSFPLPHHK

SEQ ID NO: 4432 - protein, 17 aa, Homo sapiens
PEARPNSMVVEHPEFLK

SEQ ID NO: 4433 - protein, 11 aa, Homo sapiens
PEFLRPVPQLR

SEQ ID NO: 4434 - protein, 12 aa, Homo sapiens
PEFYDYDVALIK

SEQ ID NO: 4435 - protein, 11 aa, Homo sapiens
PEHVFIHPGWK

SEQ ID NO: 4436 - protein, 7 aa, Homo sapiens
PENWLWR

SEQ ID NO: 4437 - protein, 13 aa, Homo sapiens
PESWLWEVHLVPR

SEQ ID NO: 4438 - protein, 23 aa, Homo sapiens
PETEEAALVAIDYINQNLPWGYK

SEQ ID NO: 4439 - protein, 9 aa, Homo sapiens
PFATELHER

SEQ ID NO: 4440 - protein, 11 aa, Homo sapiens
PFDPQDTHQSR

SEQ ID NO: 4441 - protein, 9 aa, Homo sapiens
PFLLQALVR

SEQ ID NO: 4442 - protein, 21 aa, Homo sapiens
PGAAANLELIFVGPQHAGNYR

SEQ ID NO: 4443 - protein, 10 aa, Homo sapiens
PGETLTYVWK

SEQ ID NO: 4444 - protein, 14 aa, Homo sapiens
PGGGFVPNFQLFEK

SEQ ID NO: 4445 - protein, 14 aa, Homo sapiens
PGHLDEMQLDIQAR

SEQ ID NO: 4446 - protein, 23 aa, Homo sapiens
PGKPYILTVPGHLDEMQLDIQAR

SEQ ID NO: 4447 - protein, 13 aa, Homo sapiens
PGLYYFTYHASSR

SEQ ID NO: 4448 - protein, 11 aa, Homo sapiens
PGQVDAAMAGR

SEQ ID NO: 4449 - protein, 12 aa, Homo sapiens
PGTYQTLEMFPR

SEQ ID NO: 4450 - protein, 7 aa, Homo sapiens
PGVLSSR

SEQ ID NO: 4451 - protein, 9 aa, Homo sapiens
PHANEVSQK

SEQ ID NO: 4452 - protein, 12 aa, Homo sapiens
PHDFENGEYWPR

SEQ ID NO: 4453 - protein, 11 aa, Homo sapiens
PHHNYNAAINK

SEQ ID NO: 4454 - protein, 9 aa, Homo sapiens
PHYHSFDGR

SEQ ID NO: 4455 - protein, 10 aa, Homo sapiens
PHYVTLDGHR

SEQ ID NO: 4456 - protein, 10 aa, Homo sapiens
PIKLTQVEHR

SEQ ID NO: 4457 - protein, 10 aa, Homo sapiens
PIPNKVIFIR

SEQ ID NO: 4458 - protein, 16 aa, Homo sapiens
PITVIDEIRDLLYIGK

SEQ ID NO: 4459 - protein, 9 aa, Homo sapiens
PIYNLVPVK

SEQ ID NO: 4460 - protein, 8 aa, Homo sapiens
PIYNPGQR

SEQ ID NO: 4461 - protein, 10 aa, Homo sapiens
PKVVEEQESR

SEQ ID NO: 4462 - protein, 7 aa, Homo sapiens
PLAEDVR

SEQ ID NO: 4463 - protein, 19 aa, Homo sapiens
PLAEDVRGNLRGNTEGLQK

SEQ ID NO: 4464 - protein, 12 aa, Homo sapiens
PLDFKENAEQSR

SEQ ID NO: 4465 - protein, 22 aa, Homo sapiens
PLLMDSVIQALAELEQKVPAAK

SEQ ID NO: 4466 - protein, 24 aa, Homo sapiens
PLLVDVDLQYPQDAVLALTQNHHK

SEQ ID NO: 4467 - protein, 6 aa, Homo sapiens
PLNMGK

SEQ ID NO: 4468 - protein, 10 aa, Homo sapiens
PLNTIIFMGR

SEQ ID NO: 4469 - protein, 10 aa, Homo sapiens
PLSIEPIGVR

SEQ ID NO: 4470 - protein, 7 aa, Homo sapiens
PLYELVK

SEQ ID NO: 4471 - protein, 8 aa, Homo sapiens
PMVPPGIK

SEQ ID NO: 4472 - protein, 9 aa, Homo sapiens
PNKPGVYVR

SEQ ID NO: 4473 - protein, 8 aa, Homo sapiens
PNKVIFIR

SEQ ID NO: 4474 - protein, 8 aa, Homo sapiens
PNSGPHNR

SEQ ID NO: 4475 - protein, 17 aa, Homo sapiens
PNSPLDEENLTQENQDR

SEQ ID NO: 4476 - protein, 9 aa, Homo sapiens
PPFKPHGSR

SEQ ID NO: 4477 - protein, 20 aa, Homo sapiens
PPLHIYWMNIELEHIEQDER

SEQ ID NO: 4478 - protein, 21 aa, Homo sapiens
PPPPVLMHHGESSQVLHPGNK

SEQ ID NO: 4479 - protein, 11 aa, Homo sapiens
PPRDFHINLFR

SEQ ID NO: 4480 - protein, 21 aa, Homo sapiens
PPSASHVAPTETFTYEWTVPK

SEQ ID NO: 4481 - protein, 11 aa, Homo sapiens
PPSFASIFLTK

SEQ ID NO: 4482 - protein, 20 aa, Homo sapiens
PPSGGPGFLSIERPDSRPPR

SEQ ID NO: 4483 - protein, 13 aa, Homo sapiens
PPVDLDLDKEAHR

SEQ ID NO: 4484 - protein, 8 aa, Homo sapiens
PQDTHQSR

SEQ ID NO: 4485 - protein, 14 aa, Homo sapiens
PQLSTEELVSLGEK

SEQ ID NO: 4486 - protein, 13 aa, Homo sapiens
PQVSMFFTHTFPK

SEQ ID NO: 4487 - protein, 9 aa, Homo sapiens
PSGEVSHPR

SEQ ID NO: 4488 - protein, 19 aa, Homo sapiens
PSGGPGFLSIERPDSRPPR

SEQ ID NO: 4489 - protein, 13 aa, Homo sapiens
PSGGTNINEALLR

SEQ ID NO: 4490 - protein, 12 aa, Homo sapiens
PSGVPDRFSGSK

SEQ ID NO: 4491 - protein, 17 aa, Homo sapiens
PSLSHLLSQYYGAGVAR

SEQ ID NO: 4492 - protein, 22 aa, Homo sapiens
PSLSHLLSQYYGAGVARDPGFR

SEQ ID NO: 4493 - protein, 6 aa, Homo sapiens
PTAAAK

SEQ ID NO: 4494 - protein, 9 aa, Homo sapiens
PTDSELAPR

SEQ ID NO: 4495 - protein, 12 aa, Homo sapiens
PTDTQNIFFMSK

SEQ ID NO: 4496 - protein, 17 aa, Homo sapiens
PTNSPELEETLTHTITK

SEQ ID NO: 4497 - protein, 14 aa, Homo sapiens
PTVDQVDDTSIVVR

SEQ ID NO: 4498 - protein, 17 aa, Homo sapiens
PVAFSVVPTAAAAVSLK

SEQ ID NO: 4499 - protein, 7 aa, Homo sapiens
PVDAAFR

SEQ ID NO: 4500 - protein, 14 aa, Homo sapiens
PVLIDFFEDTERYR

SEQ ID NO: 4501 - protein, 9 aa, Homo sapiens
PVRGEVPPR

SEQ ID NO: 4502 - protein, 12 aa, Homo sapiens
PVRGEVPPRYPR

SEQ ID NO: 4503 - protein, 8 aa, Homo sapiens
PVSDRVTK

SEQ ID NO: 4504 - protein, 8 aa, Homo sapiens
PVSKPEIR

SEQ ID NO: 4505 - protein, 12 aa, Homo sapiens
PVSYQHDLALLR

SEQ ID NO: 4506 - protein, 7 aa, Homo sapiens
PVTQYLK

SEQ ID NO: 4507 - protein, 7 aa, Homo sapiens
PYADEFK

SEQ ID NO: 4508 - protein, 9 aa, Homo sapiens
PYADEFKVK

SEQ ID NO: 4509 - protein, 7 aa, Homo sapiens
PYADQLR

SEQ ID NO: 4510 - protein, 9 aa, Homo sapiens
PYAQDTQEK

SEQ ID NO: 4511 - protein, 22 aa, Homo sapiens
PYAQDTQEKLNHQLEGLTFQMK

SEQ ID NO: 4512 - protein, 8 aa, Homo sapiens
PYGENFNK

SEQ ID NO: 4513 - protein, 13 aa, Homo sapiens
PYSLHAHGLSYEK

SEQ ID NO: 4514 - protein, 13 aa, Homo sapiens
PYTFHSHGITYYK

SEQ ID NO: 4515 - protein, 28 aa, Homo sapiens
QAAGSGHLLALGTPENPSWLSLHLQDQK

SEQ ID NO: 4516 - protein, 20 aa, Homo sapiens
QANKALEKYKEENDDFASFR

SEQ ID NO: 4517 - protein, 13 aa, Homo sapiens
QAVDTAVDGVFIR

SEQ ID NO: 4518 - protein, 9 aa, Homo sapiens
QDGSVDFFR

SEQ ID NO: 4519 - protein, 11 aa, Homo sapiens
QDNEILIFWSK

SEQ ID NO: 4520 - protein, 17 aa, Homo sapiens
QDPPSVVVTSHQAPGEK

SEQ ID NO: 4521 - protein, 12 aa, Homo sapiens
QEINSHVEMQTK

SEQ ID NO: 4522 - protein, 14 aa, Homo sapiens
QEPGENSEILPTLK

SEQ ID NO: 4523 - protein, 17 aa, Homo sapiens
QEPSQGTTTFAVTSILR

SEQ ID NO: 4524 - protein, 19 aa, Homo sapiens
QESSEISLSVGQVVDIIEK

SEQ ID NO: 4525 - protein, 9 aa, Homo sapiens
QFPILLDFK

SEQ ID NO: 4526 - protein, 23 aa, Homo sapiens
QFQADFTSLSDQEPLHVAQALQK

SEQ ID NO: 4527 - protein, 16 aa, Homo sapiens
QFSFPLSSEPFQGSYK

SEQ ID NO: 4528 - protein, 10 aa, Homo sapiens
QFTSSTSYNR

SEQ ID NO: 4529 - protein, 17 aa, Homo sapiens
QFTSSTSYNRGDSTFES

SEQ ID NO: 4530 - protein, 18 aa, Homo sapiens
QFTSSTSYNRGDSTFESK

SEQ ID NO: 4531 - protein, 13 aa, Homo sapiens
QGASGIKEIIQEK

SEQ ID NO: 4532 - protein, 14 aa, Homo sapiens
QGETLNFLEIGYSR

SEQ ID NO: 4533 - protein, 10 aa, Homo sapiens
QGFFPDSVNK

SEQ ID NO: 4534 - protein, 22 aa, Homo sapiens
QGHNSVFLIKGDKVWVYPPEKK

SEQ ID NO: 4535 - protein, 10 aa, Homo sapiens
QGIPFFGQVR

SEQ ID NO: 4536 - protein, 22 aa, Homo sapiens
QGPVNLLSDPEQGVEVTGQYER

SEQ ID NO: 4537 - protein, 9 aa, Homo sapiens
QGSFQGGFR

SEQ ID NO: 4538 - protein, 12 aa, Homo sapiens
QHLEPTGTIDMR

SEQ ID NO: 4539 - protein, 12 aa, Homo sapiens
QHLGDVLNFLPL

SEQ ID NO: 4540 - protein, 17 aa, Homo sapiens
QHVVSVEEALLATGQWK

SEQ ID NO: 4541 - protein, 20 aa, Homo sapiens
QHVVYGPWNLPQSSYSHLTR

SEQ ID NO: 4542 - protein, 8 aa, Homo sapiens
QIDDIDVR

SEQ ID NO: 4543 - protein, 7 aa, Homo sapiens
QIGSVYR

SEQ ID NO: 4544 - protein, 12 aa, Homo sapiens
QIGSVYRLPPLR

SEQ ID NO: 4545 - protein, 13 aa, Homo sapiens
QINDYVEKGTQGK

SEQ ID NO: 4546 - protein, 7 aa, Homo sapiens
QINSYVK

SEQ ID NO: 4547 - protein, 11 aa, Homo sapiens
QIQVFEDEPAR

SEQ ID NO: 4548 - protein, 8 aa, Homo sapiens
QIQVSWLR

SEQ ID NO: 4549 - protein, 28 aa, Homo sapiens
QKDVDKEFYLFPTVFDENESLLLEDNIR

SEQ ID NO: 4550 - protein, 11 aa, Homo sapiens
QKFQSVFTVTR

SEQ ID NO: 4551 - protein, 15 aa, Homo sapiens
QKISEGLPALEFPNE

SEQ ID NO: 4552 - protein, 19 aa, Homo sapiens
QKLGPHAGDVEGHLSFLEK

SEQ ID NO: 4553 - protein, 22 aa, Homo sapiens
QKLGPHAGDVEGHLSFLEKDLR

SEQ ID NO: 4554 - protein, 9 aa, Homo sapiens
QKLHELQEK

SEQ ID NO: 4555 - protein, 11 aa, Homo sapiens
QKLTPLYELVK

SEQ ID NO: 4556 - protein, 23 aa, Homo sapiens
QKPDGVFQEDAPVIHQEMIGGLR

SEQ ID NO: 4557 - protein, 15 aa, Homo sapiens
QKVEPLRAELQEGAR

SEQ ID NO: 4558 - protein, 7 aa, Homo sapiens
QLEAIVR

SEQ ID NO: 4559 - protein, 8 aa, Homo sapiens
QLEWGLER

SEQ ID NO: 4560 - protein, 15 aa, Homo sapiens
QLGLPGPPDVPDHAA

SEQ ID NO: 4561 - protein, 6 aa, Homo sapiens
QLKNVK

SEQ ID NO: 4562 - protein, 22 aa, Homo sapiens
QLNALFQDKLGEVNTYAGDLQK

SEQ ID NO: 4563 - protein, 11 aa, Homo sapiens
QLNEINYEDHK

SEQ ID NO: 4564 - protein, 13 aa, Homo sapiens
QLNEINYEDHKLK

SEQ ID NO: 4565 - protein, 19 aa, Homo sapiens
QLPGGQNPVSYVYLEVVSK

SEQ ID NO: 4566 - protein, 14 aa, Homo sapiens
QLSLLDRFTEDAKR

SEQ ID NO: 4567 - protein, 8 aa, Homo sapiens
QLTPYAQR

SEQ ID NO: 4568 - protein, 18 aa, Homo sapiens
QLTSGPNQEQVSPLTLLK

SEQ ID NO: 4569 - protein, 20 aa, Homo sapiens
QLVHHFEIDVDIFEPQGISK

SEQ ID NO: 4570 - protein, 29 aa, Homo sapiens
QLYNVEATSYALLALLQLKDFDFVPPVVR

SEQ ID NO: 4571 - protein, 13 aa, Homo sapiens
QMEQTYWQANPFR

SEQ ID NO: 4572 - protein, 10 aa, Homo sapiens
QMSKYPSGER

SEQ ID NO: 4573 - protein, 6 aa, Homo sapiens
QNALLR

SEQ ID NO: 4574 - protein, 11 aa, Homo sapiens
QNDFNSVEEKK

SEQ ID NO: 4575 - protein, 25 aa, Homo sapiens
QNGAALTSASILAQQVWGTLVLLQR

SEQ ID NO: 4576 - protein, 17 aa, Homo sapiens
QPFVQGLALYTPVVLPR

SEQ ID NO: 4577 - protein, 31 aa, Homo sapiens
QPYSYDFPEDVAPALGTSFSHMLGATNPTQK

SEQ ID NO: 4578 - protein, 23 aa, Homo sapiens
QQNAQGGFSSTQDTVVALHALSK

SEQ ID NO: 4579 - protein, 10 aa, Homo sapiens
QQTEWQSGQR

SEQ ID NO: 4580 - protein, 26 aa, Homo sapiens
QRPPDLDTSSNAVDLLFFTDESGDSR

SEQ ID NO: 4581 - protein, 12 aa, Homo sapiens
QSEDSTFYLGER

SEQ ID NO: 4582 - protein, 13 aa, Homo sapiens
QSLEASLAETEGR

SEQ ID NO: 4583 - protein, 8 aa, Homo sapiens
QSLEVIGK

SEQ ID NO: 4584 - protein, 7 aa, Homo sapiens
QSTITSR

SEQ ID NO: 4585 - protein, 10 aa, Homo sapiens
QSTNAYPDLR

SEQ ID NO: 4586 - protein, 13 aa, Homo sapiens
QSTQTLYVNVAPR

SEQ ID NO: 4587 - protein, 13 aa, Homo sapiens
QTEQTYWQATPFR

SEQ ID NO: 4588 - protein, 13 aa, Homo sapiens
QTHQPPAPNSLIR

SEQ ID NO: 4589 - protein, 17 aa, Homo sapiens
QTQVSVLPEGGETPLFK

SEQ ID NO: 4590 - protein, 7 aa, Homo sapiens
QTVEAMK

SEQ ID NO: 4591 - protein, 29 aa, Homo sapiens
QTVEAMKTILDDLRAEDHFSVIDFNQNIR

SEQ ID NO: 4592 - protein, 16 aa, Homo sapiens
QVEGMEDWKQDSQLQK

SEQ ID NO: 4593 - protein, 19 aa, Homo sapiens
QVFLYPEKDEPTYILNIKR

SEQ ID NO: 4594 - protein, 16 aa, Homo sapiens
QVGSGVTTDQVQAEAK

SEQ ID NO: 4595 - protein, 24 aa, Homo sapiens
QVGSGVTTDQVQAEAKESGPTTYK

SEQ ID NO: 4596 - protein, 10 aa, Homo sapiens
QVLDNLTMEK

SEQ ID NO: 4597 - protein, 15 aa, Homo sapiens
QVLLVGAPTYDDVSK

SEQ ID NO: 4598 - protein, 7 aa, Homo sapiens
QVPAHAR

SEQ ID NO: 4599 - protein, 9 aa, Homo sapiens
QVSGPLTSK

SEQ ID NO: 4600 - protein, 13 aa, Homo sapiens
QVTQSYWDTNPTR

SEQ ID NO: 4601 - protein, 9 aa, Homo sapiens
QVVAGLNFR

SEQ ID NO: 4602 - protein, 10 aa, Homo sapiens
QYNVGPSVSK

SEQ ID NO: 4603 - protein, 14 aa, Homo sapiens
QYNVGPSVSKYPLR

SEQ ID NO: 4604 - protein, 8 aa, Homo sapiens
QYTDSTFR

SEQ ID NO: 4605 - protein, 13 aa, Homo sapiens
QYTDSTFRVPVER

SEQ ID NO: 4606 - protein, 13 aa, Homo sapiens
QYYEGSEIVVAGR

SEQ ID NO: 4607 - protein, 25 aa, Homo sapiens
RAEVSADQVATVMWDYFSQLSNNAK

SEQ ID NO: 4608 - protein, 12 aa, Homo sapiens
RALDFAVGEYNK

SEQ ID NO: 4609 - protein, 18 aa, Homo sapiens
RAPYPNYDRDILTIDIGR

SEQ ID NO: 4610 - protein, 14 aa, Homo sapiens
RAQLGDLPWQVAIK

SEQ ID NO: 4611 - protein, 7 aa, Homo sapiens
RAVNDER

SEQ ID NO: 4612 - protein, 10 aa, Homo sapiens
RDGYLFQLLR

SEQ ID NO: 4613 - protein, 14 aa, Homo sapiens
RDPSPVSGPVHLFR

SEQ ID NO: 4614 - protein, 29 aa, Homo sapiens
REEKAGELEVFNGYFVHFFAPDNLDPIPK

SEQ ID NO: 4615 - protein, 12 aa, Homo sapiens
RELDESLQVAER

SEQ ID NO: 4616 - protein, 9 aa, Homo sapiens
REQPGVYTK

SEQ ID NO: 4617 - protein, 8 aa, Homo sapiens
RFEQLELR

SEQ ID NO: 4618 - protein, 17 aa, Homo sapiens
RFEQLELRPVLYNYLDK

SEQ ID NO: 4619 - protein, 9 aa, Homo sapiens
RFNALQYLR

SEQ ID NO: 4620 - protein, 12 aa, Homo sapiens
RGADGDSSGGER

SEQ ID NO: 4621 - protein, 10 aa, Homo sapiens
RGDSFLDGTR

SEQ ID NO: 4622 - protein, 12 aa, Homo sapiens
RGDSGGPLIVHK

SEQ ID NO: 4623 - protein, 14 aa, Homo sapiens
RGDSPWQVVLLDSK

SEQ ID NO: 4624 - protein, 15 aa, Homo sapiens
RGDSPWQVVLLDSKK

SEQ ID NO: 4625 - protein, 10 aa, Homo sapiens
RGEKELLVPR

SEQ ID NO: 4626 - protein, 9 aa, Homo sapiens
RGFSANSAR

SEQ ID NO: 4627 - protein, 18 aa, Homo sapiens
RGHLFLQTDQPIYNPGQR

SEQ ID NO: 4628 - protein, 8 aa, Homo sapiens
RHDWGHEK

SEQ ID NO: 4629 - protein, 9 aa, Homo sapiens
RHDWGHEKQ

SEQ ID NO: 4630 - protein, 12 aa, Homo sapiens
RHEDTLTLFPMR

SEQ ID NO: 4631 - protein, 16 aa, Homo sapiens
RHLVPGAPFLLQALVR

SEQ ID NO: 4632 - protein, 6 aa, Homo sapiens
RHMPLR

SEQ ID NO: 4633 - protein, 12 aa, Homo sapiens
RHPDLSIPELLR

SEQ ID NO: 4634 - protein, 10 aa, Homo sapiens
RIDITLSSVK

SEQ ID NO: 4635 - protein, 11 aa, Homo sapiens
RIEDIHLLVER

SEQ ID NO: 4636 - protein, 18 aa, Homo sapiens
RITEVWGIPSPIDTVFTR

SEQ ID NO: 4637 - protein, 9 aa, Homo sapiens
RIVIEYVDR

SEQ ID NO: 4638 - protein, 7 aa, Homo sapiens
RKEFPYR

SEQ ID NO: 4639 - protein, 15 aa, Homo sapiens
RKEFPYRIPLDLVPK

SEQ ID NO: 4640 - protein, 11 aa, Homo sapiens
RKGVELKDIKR

SEQ ID NO: 4641 - protein, 33 aa, Homo sapiens
RKLEFALLFLVFDENESWYLDDNIKTYSDHPEK

SEQ ID NO: 4642 - protein, 14 aa, Homo sapiens
RLEAGDHPVELLAR

SEQ ID NO: 4643 - protein, 9 aa, Homo sapiens
RLEEDAFAR

SEQ ID NO: 4644 - protein, 10 aa, Homo sapiens
RLFQPLTHLK

SEQ ID NO: 4645 - protein, 21 aa, Homo sapiens
RLIDQYGTHYLQSGSLGGEYR

SEQ ID NO: 4646 - protein, 12 aa, Homo sapiens
RLPLEYSYGEYR

SEQ ID NO: 4647 - protein, 16 aa, Homo sapiens
RLPLEYSYGEYRDLFR

SEQ ID NO: 4648 - protein, 15 aa, Homo sapiens
RLQSIGTENTEENRR

SEQ ID NO: 4649 - protein, 18 aa, Homo sapiens
RLSEDYGVLKTDEGIAYR

SEQ ID NO: 4650 - protein, 12 aa, Homo sapiens
RLSNENHGIAQR

SEQ ID NO: 4651 - protein, 19 aa, Homo sapiens
RLTVGAAQVPAQLLVGALR

SEQ ID NO: 4652 - protein, 14 aa, Homo sapiens
RLVKGPDPSSPAFR

SEQ ID NO: 4653 - protein, 19 aa, Homo sapiens
RLYGSEAFATDFQDSAAAK

SEQ ID NO: 4654 - protein, 20 aa, Homo sapiens
RLYGSEAFATDFQDSAAAKK

SEQ ID NO: 4655 - protein, 27 aa, Homo sapiens
RMPITYDNGFLFIHTDKPVYTPDQSVK

SEQ ID NO: 4656 - protein, 20 aa, Homo sapiens
RNDYLDIYAIGVGKLDVDWR

SEQ ID NO: 4657 - protein, 8 aa, Homo sapiens
RNFGYTLR

SEQ ID NO: 4658 - protein, 11 aa, Homo sapiens
RNHMQYEIVIK

SEQ ID NO: 4659 - protein, 22 aa, Homo sapiens
RNPFVFAPTLLTVAVHFEEVAK

SEQ ID NO: 4660 - protein, 24 aa, Homo sapiens
RNTEILTGSWSDQTYPEGTQAIYK

SEQ ID NO: 4661 - protein, 12 aa, Homo sapiens
RPASPISTIQPK

SEQ ID NO: 4662 - protein, 15 aa, Homo sapiens
RPDSLQHVLLPVLDR

SEQ ID NO: 4663 - protein, 22 aa, Homo sapiens
RPGGEPSPEGTTGQSYNQYSQR

SEQ ID NO: 4664 - protein, 10 aa, Homo sapiens
RPGVYTQVTK

SEQ ID NO: 4665 - protein, 8 aa, Homo sapiens
RPHFFFPK

SEQ ID NO: 4666 - protein, 8 aa, Homo sapiens
RPPGFSPF

SEQ ID NO: 4667 - protein, 9 aa, Homo sapiens
RPPGFSPFR

SEQ ID NO: 4668 - protein, 8 aa, Homo sapiens
RPSGIPER

SEQ ID NO: 4669 - protein, 13 aa, Homo sapiens
RPSGVPDRFSGSK

SEQ ID NO: 4670 - protein, 13 aa, Homo sapiens
RPWNVASLIYETK

SEQ ID NO: 4671 - protein, 10 aa, Homo sapiens
RPYFPVAVGK

SEQ ID NO: 4672 - protein, 10 aa, Homo sapiens
RQDGSVDFFR

SEQ ID NO: 4673 - protein, 12 aa, Homo sapiens
RQDNEILIFWSK

SEQ ID NO: 4674 - protein, 9 aa, Homo sapiens
RQLTPYAQR

SEQ ID NO: 4675 - protein, 13 aa, Homo sapiens
RQSEDSTFYLGER

SEQ ID NO: 4676 - protein, 11 aa, Homo sapiens
RRDGYLFQLLR

SEQ ID NO: 4677 - protein, 12 aa, Homo sapiens
RRVEPYGENFNK

SEQ ID NO: 4678 - protein, 12 aa, Homo sapiens
RSENINHNSAFK

SEQ ID NO: 4679 - protein, 15 aa, Homo sapiens
RTASTPTPDDKLFQK

SEQ ID NO: 4680 - protein, 8 aa, Homo sapiens
RTPITVVK

SEQ ID NO: 4681 - protein, 12 aa, Homo sapiens
RTQVNTQAEQLR

SEQ ID NO: 4682 - protein, 15 aa, Homo sapiens
RTTNIQGINLLFSSR

SEQ ID NO: 4683 - protein, 29 aa, Homo sapiens
RVAEGTQVLELPFKGDDITMVLILPKPEK

SEQ ID NO: 4684 - protein, 9 aa, Homo sapiens
RVDADADPR

SEQ ID NO: 4685 - protein, 16 aa, Homo sapiens
RVDGSVDFYRDWATYK

SEQ ID NO: 4686 - protein, 11 aa, Homo sapiens
RVDTVDPPYPR

SEQ ID NO: 4687 - protein, 11 aa, Homo sapiens
RVEPLRNELQK

SEQ ID NO: 4688 - protein, 11 aa, Homo sapiens
RVEPYGENFNK

SEQ ID NO: 4689 - protein, 31 aa, Homo sapiens; identical to SEQ ID NO: 661

SEQ ID NO: 4690 - protein, 8 aa, Homo sapiens
RVWNYFQR

SEQ ID NO: 4691 - protein, 9 aa, Homo sapiens
RWRDSLEFR

SEQ ID NO: 4692 - protein, 10 aa, Homo sapiens
RYIETDPANR

SEQ ID NO: 4693 - protein, 12 aa, Homo sapiens
RYIETDPANRDR

SEQ ID NO: 4694 - protein, 13 aa, Homo sapiens
RYIETDPANRDRR

SEQ ID NO: 4695 - protein, 17 aa, Homo sapiens
RYSAWAESVTNLPQVIK

SEQ ID NO: 4696 - protein, 10 aa, Homo sapiens
SADTLWDIQK

SEQ ID NO: 4697 - protein, 15 aa, Homo sapiens
SADTLWDIQKDLKDL

SEQ ID NO: 4698 - protein, 15 aa, Homo sapiens
SAGLTSSQVDLYIPK

SEQ ID NO: 4699 - protein, 20 aa, Homo sapiens
SAHGNVAEGETKPDPDVTER

SEQ ID NO: 4700 - protein, 11 aa, Homo sapiens
SAQQVQGVHAR

SEQ ID NO: 4701 - protein, 8 aa, Homo sapiens
SASAEELR

SEQ ID NO: 4702 - protein, 8 aa, Homo sapiens
SASLHLPK

SEQ ID NO: 4703 - protein, 11 aa, Homo sapiens
SASNMAIVDVK

SEQ ID NO: 4704 - protein, 18 aa, Homo sapiens
SAVDPTKDIFTGLIGPMK

SEQ ID NO: 4705 - protein, 11 aa, Homo sapiens
SDENEQHLGVK

SEQ ID NO: 4706 - protein, 8 aa, Homo sapiens
SDIAPVAR

SEQ ID NO: 4707 - protein, 13 aa, Homo sapiens
SDLAVPSELALLK

SEQ ID NO: 4708 - protein, 9 aa, Homo sapiens
SDLEVAHYK

SEQ ID NO: 4709 - protein, 12 aa, Homo sapiens
SDTFYSFKYEIK

SEQ ID NO: 4710 - protein, 11 aa, Homo sapiens
SDTSSNHAVLK

SEQ ID NO: 4711 - protein, 8 aa, Homo sapiens
SDTVPSPR

SEQ ID NO: 4712 - protein, 17 aa, Homo sapiens
SDVGFLPPFPTLDPEEK

SEQ ID NO: 4713 - protein, 10 aa, Homo sapiens
SDVMYTDWKK

SEQ ID NO: 4714 - protein, 10 aa, Homo sapiens
SDVVYTDWKK

SEQ ID NO: 4715 - protein, 11 aa, Homo sapiens
SEDSTFYLGER

SEQ ID NO: 4716 - protein, 17 aa, Homo sapiens
SEETKENEGFTVTAEGK

SEQ ID NO: 4717 - protein, 13 aa, Homo sapiens
SEHQAQQNQAEFR

SEQ ID NO: 4718 - protein, 11 aa, Homo sapiens
SEILAHWSPAK

SEQ ID NO: 4719 - protein, 18 aa, Homo sapiens
SELTQDPAVSVALGQTVR

SEQ ID NO: 4720 - protein, 14 aa, Homo sapiens
SELTQQLNALFQDK

SEQ ID NO: 4721 - protein, 27 aa, Homo sapiens
SELTQQLNALFQDKLGEVNTYAGDLQK

SEQ ID NO: 4722 - protein, 11 aa, Homo sapiens
SENINHNSAFK

SEQ ID NO: 4723 - protein, 10 aa, Homo sapiens
SESLKDVLER

SEQ ID NO: 4724 - protein, 15 aa, Homo sapiens
SETEIHQGFQHLHQL

SEQ ID NO: 4725 - protein, 18 aa, Homo sapiens
SETEIHQGFQHLHQLFAK

SEQ ID NO: 4726 - protein, 11 aa, Homo sapiens
SEYGAALAWEK

SEQ ID NO: 4727 - protein, 19 aa, Homo sapiens
SEYGAALAWEKGSSGLEEK

SEQ ID NO: 4728 - protein, 9 aa, Homo sapiens
SEYMEGNVR

SEQ ID NO: 4729 - protein, 22 aa, Homo sapiens
SFEGLGQLEVLTLDHNQLQEVK

SEQ ID NO: 4730 - protein, 10 aa, Homo sapiens
SFFPENWLWR

SEQ ID NO: 4731 - protein, 9 aa, Homo sapiens
SFMLLILER

SEQ ID NO: 4732 - protein, 9 aa, Homo sapiens
SFNPNSPGK

SEQ ID NO: 4733 - protein, 11 aa, Homo sapiens
SFQTGLFTAAR

SEQ ID NO: 4734 - protein, 13 aa, Homo sapiens
SFSIIGDFQNGKR

SEQ ID NO: 4735 - protein, 23 aa, Homo sapiens
SFTLASSETGVGAPISGPGIPGR

SEQ ID NO: 4736 - protein, 9 aa, Homo sapiens
SFYTAYLQR

SEQ ID NO: 4737 - protein, 16 aa, Homo sapiens
SGAQATWTELPWPHEK

SEQ ID NO: 4738 - protein, 8 aa, Homo sapiens
SGAVLAGR

SEQ ID NO: 4739 - protein, 14 aa, Homo sapiens
SGEGDFLAEGGGVR

SEQ ID NO: 4740 - protein, 10 aa, Homo sapiens
SGEIAIDDIR

SEQ ID NO: 4741 - protein, 9 aa, Homo sapiens
SGENAGLVR

SEQ ID NO: 4742 - protein, 11 aa, Homo sapiens
SGFIPLKPTVK

SEQ ID NO: 4743 - protein, 16 aa, Homo sapiens
SGFPQVSMFFTHTFPK

SEQ ID NO: 4744 - protein, 8 aa, Homo sapiens
SGFSFGFK

SEQ ID NO: 4745 - protein, 16 aa, Homo sapiens
SGGGGGGGLGSGGSIR

SEQ ID NO: 4746 - protein, 10 aa, Homo sapiens
SGGPLIVHKR

SEQ ID NO: 4747 - protein, 18 aa, Homo sapiens
SGGRTEHPFTVEEFVLPK

SEQ ID NO: 4748 - protein, 27 aa, Homo sapiens
SGGRTEHPFTVEEFVLPKFEVQVTVPK

SEQ ID NO: 4749 - protein, 26 aa, Homo sapiens
SGLPVSLLTLYLDNNKISNIPDEYFK

SEQ ID NO: 4750 - protein, 12 aa, Homo sapiens
SGLSTGWTQLSK

SEQ ID NO: 4751 - protein, 13 aa, Homo sapiens
SGLTIDGHAVGAK

SEQ ID NO: 4752 - protein, 11 aa, Homo sapiens
SGMAPRPSLAK

SEQ ID NO: 4753 - protein, 22 aa, Homo sapiens
SGNTFRPEVHLLPPPSEELALN

SEQ ID NO: 4754 - protein, 8 aa, Homo sapiens
SGPVHLFR

SEQ ID NO: 4755 - protein, 13 aa, Homo sapiens
SGTSASLAISGLR

SEQ ID NO: 4756 - protein, 22 aa, Homo sapiens
SGVQMNTNFFHESGLEAHVALK

SEQ ID NO: 4757 - protein, 11 aa, Homo sapiens
SGYFLSISDSK

SEQ ID NO: 4758 - protein, 7 aa, Homo sapiens
SHDELPR

SEQ ID NO: 4759 - protein, 7 aa, Homo sapiens
SHIDAPK

SEQ ID NO: 4760 - protein, 9 aa, Homo sapiens
SHKPLNMGK

SEQ ID NO: 4761 - protein, 6 aa, Homo sapiens
SHKWDR

SEQ ID NO: 4762 - protein, 20 aa, Homo sapiens
SIAPGAFDRLPNLSSLTLSR

SEQ ID NO: 4763 - protein, 11 aa, Homo sapiens
SIEVFGQFNGK

SEQ ID NO: 4764 - protein, 12 aa, Homo sapiens
SIEVFGQFNGKR

SEQ ID NO: 4765 - protein, 28 aa, Homo sapiens
SIHAHGVQTESSTVTPTLPGETLTYVWK

SEQ ID NO: 4766 - protein, 7 aa, Homo sapiens
SILFLGK

SEQ ID NO: 4767 - protein, 28 aa, Homo sapiens
SILQMSLDHHIVTPLTSLVIENEAGDER

SEQ ID NO: 4768 - protein, 9 aa, Homo sapiens
SISAALEHK

SEQ ID NO: 4769 - protein, 8 aa, Homo sapiens
SIVSALKR

SEQ ID NO: 4770 - protein, 14 aa, Homo sapiens
SIVVSPILIPENQR

SEQ ID NO: 4771 - protein, 16 aa, Homo sapiens
SKDHEELSLVASEAVR

SEQ ID NO: 4772 - protein, 13 aa, Homo sapiens
SKEFQLFSSPHGK

SEQ ID NO: 4773 - protein, 11 aa, Homo sapiens
SKEQLTPLIKK

SEQ ID NO: 4774 - protein, 22 aa, Homo sapiens
SKLPGIVAEGRDDLYVSDAFHK

SEQ ID NO: 4775 - protein, 18 aa, Homo sapiens
SKSKDHEELSLVASEAVR

SEQ ID NO: 4776 - protein, 15 aa, Homo sapiens
SKVPPPRDFHINLFR

SEQ ID NO: 4777 - protein, 16 aa, Homo sapiens
SLAELGGHLDQQVEEF

SEQ ID NO: 4778 - protein, 17 aa, Homo sapiens
SLAELGGHLDQQVEEFR

SEQ ID NO: 4779 - protein, 18 aa, Homo sapiens
SLAELGGHLDQQVEEFRR

SEQ ID NO: 4780 - protein, 9 aa, Homo sapiens
SLAPTAAAK

SEQ ID NO: 4781 - protein, 10 aa, Homo sapiens
SLAPTAAAKR

SEQ ID NO: 4782 - protein, 12 aa, Homo sapiens
SLAPYAQDTQEK

SEQ ID NO: 4783 - protein, 13 aa, Homo sapiens
SLAPYAQDTQEKL

SEQ ID NO: 4784 - protein, 15 aa, Homo sapiens
SLAPYAQDTQEKLNH

SEQ ID NO: 4785 - protein, 25 aa, Homo sapiens
SLAPYAQDTQEKLNHQLEGLTFQMK

SEQ ID NO: 4786 - protein, 13 aa, Homo sapiens
SLAQEQVGGSPEK

SEQ ID NO: 4787 - protein, 14 aa, Homo sapiens
SLDEISQPAQELKR

SEQ ID NO: 4788 - protein, 16 aa, Homo sapiens
SLDFTELDVAAEKIDR

SEQ ID NO: 4789 - protein, 25 aa, Homo sapiens
SLDFTELDVAAEKIDRFMQAVTGWK

SEQ ID NO: 4790 - protein, 17 aa, Homo sapiens
SLEDKTERELLESYIDG

SEQ ID NO: 4791 - protein, 18 aa, Homo sapiens
SLEDKTERELLESYIDGR

SEQ ID NO: 4792 - protein, 11 aa, Homo sapiens
SLEDLQLTHNK

SEQ ID NO: 4793 - protein, 14 aa, Homo sapiens
SLEDLQLTHNKITK

SEQ ID NO: 4794 - protein, 13 aa, Homo sapiens
SLEVSYVTDHGPM

SEQ ID NO: 4795 - protein, 15 aa, Homo sapiens
SLEVTFTPVIEDIGK

SEQ ID NO: 4796 - protein, 14 aa, Homo sapiens
SLEYLDLSFNQIAR

SEQ ID NO: 4797 - protein, 11 aa, Homo sapiens
SLGPALLLLQK

SEQ ID NO: 4798 - protein, 13 aa, Homo sapiens
SLGSPSGEVSHPR

SEQ ID NO: 4799 - protein, 6 aa, Homo sapiens
SLGWLK

SEQ ID NO: 4800 - protein, 8 aa, Homo sapiens
SLHMYANR

SEQ ID NO: 4801 - protein, 10 aa, Homo sapiens
SLKDMEESIR

SEQ ID NO: 4802 - protein, 11 aa, Homo sapiens
SLLDRFTEDAK

SEQ ID NO: 4803 - protein, 12 aa, Homo sapiens
SLLDRFTEDAKR

SEQ ID NO: 4804 - protein, 21 aa, Homo sapiens
SLLHGDFHAFSAGPGLFSYIR

SEQ ID NO: 4805 - protein, 9 aa, Homo sapiens
SLLLEDNIR

SEQ ID NO: 4806 - protein, 27 aa, Homo sapiens
SLLSNVEGDNAVPMQHNNRPTQPLKGR

SEQ ID NO: 4807 - protein, 11 aa, Homo sapiens
SLMLHYEFLQR

SEQ ID NO: 4808 - protein, 11 aa, Homo sapiens
SLNDDLKPAKR

SEQ ID NO: 4809 - protein, 8 aa, Homo sapiens
SLNEEAVK

SEQ ID NO: 4810 - protein, 14 aa, Homo sapiens
SLNNQFASFIDKVR

SEQ ID NO: 4811 - protein, 20 aa, Homo sapiens
SLPAPWLSMAPVSWITPGLK

SEQ ID NO: 4812 - protein, 16 aa, Homo sapiens
SLPEGVANGIEVYSTK

SEQ ID NO: 4813 - protein, 19 aa, Homo sapiens
SLPLLMDSVIQALAELEQK

SEQ ID NO: 4814 - protein, 24 aa, Homo sapiens
SLPLLMDSVIQALAELEQKVPAAK

SEQ ID NO: 4815 - protein, 12 aa, Homo sapiens
SLRPHADELKAK

SEQ ID NO: 4816 - protein, 22 aa, Homo sapiens
SLSNVIAHEISHSWTGNLVTNK

SEQ ID NO: 4817 - protein, 18 aa, Homo sapiens
SLTEEAENWGDGEPNNKK

SEQ ID NO: 4818 - protein, 15 aa, Homo sapiens
SLTLGIEPVSPTSLR

SEQ ID NO: 4819 - protein, 7 aa, Homo sapiens
SMAEALA

SEQ ID NO: 4820 - protein, 16 aa, Homo sapiens
SMEDKGMTNINDGLLR

SEQ ID NO: 4821 - protein, 12 aa, Homo sapiens
SMEQNGPGLEYR

SEQ ID NO: 4822 - protein, 41 aa, Homo sapiens; identical to SEQ ID NO: 356

SEQ ID NO: 4823 - protein, 11 aa, Homo sapiens
SMVVEHPEFLK

SEQ ID NO: 4824 - protein, 16 aa, Homo sapiens
SNALDIIFQTDLTGQK

SEQ ID NO: 4825 - protein, 17 aa, Homo sapiens
SNALDIIFQTDLTGQKK

SEQ ID NO: 4826 - protein, 10 aa, Homo sapiens
SNENHGIAQR

SEQ ID NO: 4827 - protein, 10 aa, Homo sapiens
SNFQLEEISR

SEQ ID NO: 4828 - protein, 10 aa, Homo sapiens
SPAFTDLHLR

SEQ ID NO: 4829 - protein, 15 aa, Homo sapiens
SPAGPTVVSIGGGKG

SEQ ID NO: 4830 - protein, 10 aa, Homo sapiens
SPAYTLVWTR

SEQ ID NO: 4831 - protein, 13 aa, Homo sapiens
SPDVINGSPISQK

SEQ ID NO: 4832 - protein, 12 aa, Homo sapiens
SPEFLRPVPQLR

SEQ ID NO: 4833 - protein, 9 aa, Homo sapiens
SPELQAEAK

SEQ ID NO: 4834 - protein, 9 aa, Homo sapiens
SPENSLDPK

SEQ ID NO: 4835 - protein, 10 aa, Homo sapiens
SPGFDVFAKK

SEQ ID NO: 4836 - protein, 10 aa, Homo sapiens
SPIYNLVPVK

SEQ ID NO: 4837 - protein, 15 aa, Homo sapiens
SPLDEENLTQENQDR

SEQ ID NO: 4838 - protein, 7 aa, Homo sapiens
SPLFMGK

SEQ ID NO: 4839 - protein, 30 aa, Homo sapiens
SPPEEGSPDPDSTGALVEEEDPFFKVPVNK

SEQ ID NO: 4840 - protein, 24 aa, Homo sapiens
SPPTMVDSLLAVTLAGNLGLTFLR

SEQ ID NO: 4841 - protein, 15 aa, Homo sapiens
SPQPQNVVFDVQIPK

SEQ ID NO: 4842 - protein, 10 aa, Homo sapiens
SPSGEVSHPR

SEQ ID NO: 4843 - protein, 10 aa, Homo sapiens
SPVIDHQGTK

SEQ ID NO: 4844 - protein, 18 aa, Homo sapiens
SPVTLLAAVMSLPEEHNK

SEQ ID NO: 4845 - protein, 17 aa, Homo sapiens
SPYIDKITHYNYLILSK

SEQ ID NO: 4846 - protein, 10 aa, Homo sapiens
SQDASDGLQR

SEQ ID NO: 4847 - protein, 11 aa, Homo sapiens
SQEFLEDADRK

SEQ ID NO: 4848 - protein, 13 aa, Homo sapiens
SQHLDNFSNQIGK

SEQ ID NO: 4849 - protein, 8 aa, Homo sapiens
SQLVYQSR

SEQ ID NO: 4850 - protein, 13 aa, Homo sapiens
SQNQSNNQFVLYR

SEQ ID NO: 4851 - protein, 8 aa, Homo sapiens
SQPMGLWR

SEQ ID NO: 4852 - protein, 25 aa, Homo sapiens
SQPSQPSDHHETPPAAPDRNPQNIR

SEQ ID NO: 4853 - protein, 16 aa, Homo sapiens
SQVDSQHVGHSVLTAK

SEQ ID NO: 4854 - protein, 11 aa, Homo sapiens
SQWGKEFLIEK

SEQ ID NO: 4855 - protein, 9 aa, Homo sapiens
SQYAAYGEK

SEQ ID NO: 4856 - protein, 12 aa, Homo sapiens
SQYEQLAEQNRK

SEQ ID NO: 4857 - protein, 17 aa, Homo sapiens
SRATLYALSHAVNNYHK

SEQ ID NO: 4858 - protein, 14 aa, Homo sapiens
SRLDTLAQEVALLK

SEQ ID NO: 4859 - protein, 11 aa, Homo sapiens
SRLPVSLSEGR

SEQ ID NO: 4860 - protein, 10 aa, Homo sapiens
SSALDMENFR

SEQ ID NO: 4861 - protein, 20 aa, Homo sapiens
SSALDMENFRTEVNVLPGAK

SEQ ID NO: 4862 - protein, 17 aa, Homo sapiens
SSAMEPDREYHFGQAVR

SEQ ID NO: 4863 - protein, 7 aa, Homo sapiens
SSAYKWK

SEQ ID NO: 4864 - protein, 13 aa, Homo sapiens
SSDRVDGPASNLK

SEQ ID NO: 4865 - protein, 12 aa, Homo sapiens
SSEDPNEDIVER

SEQ ID NO: 4866 - protein, 17 aa, Homo sapiens
SSFTVQDLKPFTEYVFR

SEQ ID NO: 4867 - protein, 9 aa, Homo sapiens
SSFVAPLEK

SEQ ID NO: 4868 - protein, 14 aa, Homo sapiens
SSGLVSNAPGVQIR

SEQ ID NO: 4869 - protein, 11 aa, Homo sapiens
SSGSLLNNAIK

SEQ ID NO: 4870 - protein, 12 aa, Homo sapiens
SSGVPDRFSGSK

SEQ ID NO: 4871 - protein, 30 aa, Homo sapiens; identical to SEQ ID NO: 408

SEQ ID NO: 4872 - protein, 12 aa, Homo sapiens
SSNLIILEEHLK

SEQ ID NO: 4873 - protein, 19 aa, Homo sapiens
SSNNPHSPIVEEFQVPYNK

SEQ ID NO: 4874 - protein, 25 aa, Homo sapiens
SSNNPHSPIVEEFQVPYNKLQVIFK

SEQ ID NO: 4875 - protein, 12 aa, Homo sapiens
SSNTYTLTDVRR

SEQ ID NO: 4876 - protein, 19 aa, Homo sapiens
SSPVVIDASTAIDAPSNLR

SEQ ID NO: 4877 - protein, 11 aa, Homo sapiens
SSQESYAHGTK

SEQ ID NO: 4878 - protein, 12 aa, Homo sapiens
SSQSVLYSSNNK

SEQ ID NO: 4879 - protein, 15 aa, Homo sapiens
SSSNEEVMFLTVQVK

SEQ ID NO: 4880 - protein, 14 aa, Homo sapiens
SSSPELSEMLEYDR

SEQ ID NO: 4881 - protein, 10 aa, Homo sapiens
SSTGPGEQLR

SEQ ID NO: 4882 - protein, 14 aa, Homo sapiens
SSTTKPPFKPHGSR

SEQ ID NO: 4883 - protein, 16 aa, Homo sapiens
SSVAAMHWMDGSVVTR

SEQ ID NO: 4884 - protein, 24 aa, Homo sapiens
STAAMSTYTGIFTDQVLSVLKGEE

SEQ ID NO: 4885 - protein, 21 aa, Homo sapiens
STEATQWRPSLVPASAENVNK

SEQ ID NO: 4886 - protein, 9 aa, Homo sapiens
STGSWSTLK

SEQ ID NO: 4887 - protein, 14 aa, Homo sapiens
STGSWSTLKTQDQK

SEQ ID NO: 4888 - protein, 9 aa, Homo sapiens
STHTLDLSR

SEQ ID NO: 4889 - protein, 20 aa, Homo sapiens
STKEIPDEISILLLGVAHFK

SEQ ID NO: 4890 - protein, 9 aa, Homo sapiens
STMQELNSR

SEQ ID NO: 4891 - protein, 25 aa, Homo sapiens
STQDTVIALDALSAYWIASHTTEER

SEQ ID NO: 4892 - protein, 22 aa, Homo sapiens
STSIVIMLTDGDANVGESRPEK

SEQ ID NO: 4893 - protein, 28 aa, Homo sapiens
STSIVIMLTDGDANVGESRPEKIQENVR

SEQ ID NO: 4894 - protein, 13 aa, Homo sapiens
STSPPKQAEAVLK

SEQ ID NO: 4895 - protein, 10 aa, Homo sapiens
STTPDITGYR

SEQ ID NO: 4896 - protein, 6 aa, Homo sapiens
SVAAAR

SEQ ID NO: 4897 - protein, 17 aa, Homo sapiens
SVDTEHSNIYLQNGPDR

SEQ ID NO: 4898 - protein, 7 aa, Homo sapiens
SVFLHAR

SEQ ID NO: 4899 - protein, 9 aa, Homo sapiens
SVFVDWIHK

SEQ ID NO: 4900 - protein, 9 aa, Homo sapiens
SVGFHLPSR

SEQ ID NO: 4901 - protein, 11 aa, Homo sapiens
SVHWERPQKPK

SEQ ID NO: 4902 - protein, 19 aa, Homo sapiens
SVMAPFTMTIDAHTNGNGK

SEQ ID NO: 4903 - protein, 9 aa, Homo sapiens
SVNDLYIQK

SEQ ID NO: 4904 - protein, 8 aa, Homo sapiens
SVNNVVVR

SEQ ID NO: 4905 - protein, 10 aa, Homo sapiens
SVPMVPPGIK

SEQ ID NO: 4906 - protein, 23 aa, Homo sapiens
SVPPSASHVAPTETFTYEWTVPK

SEQ ID NO: 4907 - protein, 7 aa, Homo sapiens
SVQLTEK

SEQ ID NO: 4908 - protein, 8 aa, Homo sapiens
SVQLTEKR

SEQ ID NO: 4909 - protein, 13 aa, Homo sapiens
SVSLPSLDPASAK

SEQ ID NO: 4910 - protein, 28 aa, Homo sapiens
SVSLPSLDPASAKIEGNLIFDPNNYLPK

SEQ ID NO: 4911 - protein, 12 aa, Homo sapiens
SWFEPLVEDMQR

SEQ ID NO: 4912 - protein, 15 aa, Homo sapiens
SWLAELQQWLKPGLK

SEQ ID NO: 4913 - protein, 6 aa, Homo sapiens
SWSSYR

SEQ ID NO: 4914 - protein, 13 aa, Homo sapiens
SWVPHTFESELSD

SEQ ID NO: 4915 - protein, 22 aa, Homo sapiens
SWVPHTFESELSDPVELLVAES

SEQ ID NO: 4916 - protein, 11 aa, Homo sapiens
SWWGDYWEPFR

SEQ ID NO: 4917 - protein, 16 aa, Homo sapiens
SYELPDGQVITIGNER

SEQ ID NO: 4918 - protein, 16 aa, Homo sapiens
SYFPESWLWEVHLVPR

SEQ ID NO: 4919 - protein, 7 aa, Homo sapiens
SYGVKPR

SEQ ID NO: 4920 - protein, 15 aa, Homo sapiens
SYLAWYQQKPGQAPR

SEQ ID NO: 4921 - protein, 10 aa, Homo sapiens
SYQHDLALLR

SEQ ID NO: 4922 - protein, 11 aa, Homo sapiens
SYSLLIFSLGR

SEQ ID NO: 4923 - protein, 14 aa, Homo sapiens
SYTITGLQPGTDYK

SEQ ID NO: 4924 - protein, 11 aa, Homo sapiens
SYTSHTNEIHK

SEQ ID NO: 4925 - protein, 13 aa, Homo sapiens
SYTSHTNEIHKGK

SEQ ID NO: 4926 - protein, 16 aa, Homo sapiens
SYTVAIAGYALAQMGR

SEQ ID NO: 4927 - protein, 8 aa, Homo sapiens
SYYWIGIR

SEQ ID NO: 4928 - protein, 9 aa, Homo sapiens
TAAQNLYEK

SEQ ID NO: 4929 - protein, 29 aa, Homo sapiens
YYYDGKDYIEFNKEIPAWVPFDPAAQITK

SEQ ID NO: 4930 - protein, 22 aa, Homo sapiens
TAEDYQALNKDIEAQLQHAGLR

SEQ ID NO: 4931 - protein, 28 aa, Homo sapiens
TAFISDFAVTADGNAFIGDIKDKVTAWK

SEQ ID NO: 4932 - protein, 6 aa, Homo sapiens
TAGLVK

SEQ ID NO: 4933 - protein, 6 aa, Homo sapiens
TAGLVR

SEQ ID NO: 4934 - protein, 14 aa, Homo sapiens
TAGWNIPMGLLYNK

SEQ ID NO: 4935 - protein, 19 aa, Homo sapiens
TAKDALSSVQESQVAQQAR

SEQ ID NO: 4936 - protein, 15 aa, Homo sapiens
TALDDRKEGAVLAKK

SEQ ID NO: 4937 - protein, 8 aa, Homo sapiens
TASDFITK

SEQ ID NO: 4938 - protein, 13 aa, Homo sapiens
TASDFITKMDYPK

SEQ ID NO: 4939 - protein, 14 aa, Homo sapiens
TASGVNQLVDIYEK

SEQ ID NO: 4940 - protein, 13 aa, Homo sapiens
TATSEYQTFFNPR

SEQ ID NO: 4941 - protein, 7 aa, Homo sapiens
TAVDHIR

SEQ ID NO: 4942 - protein, 15 aa, Homo sapiens
TAVDHIREILNINQK

SEQ ID NO: 4943 - protein, 13 aa, Homo sapiens
TDAPDLPEENQAR

SEQ ID NO: 4944 - protein, 8 aa, Homo sapiens
TDASFTNR

SEQ ID NO: 4945 - protein, 30 aa, Homo sapiens
TDGEGALSEPSATVTIEELAAPPPPVLMHH

SEQ ID NO: 4946 - protein, 42 aa, Homo sapiens
TDGEGALSEPSATVTIEELAAPPPPVLMHHGESSQVLHPGNK

SEQ ID NO: 4947 - protein, 10 aa, Homo sapiens
TDRFLVNLVK

SEQ ID NO: 4948 - protein, 11 aa, Homo sapiens
TDTDGKFLYHK

SEQ ID NO: 4949 - protein, 8 aa, Homo sapiens
TEDTIFLR

SEQ ID NO: 4950 - protein, 9 aa, Homo sapiens
TEFTTALQR

SEQ ID NO: 4951 - protein, 23 aa, Homo sapiens
TEHPFTVEEFVLPKFEVQVTVPK

SEQ ID NO: 4952 - protein, 12 aa, Homo sapiens
TEHYEEQIEAFK

SEQ ID NO: 4953 - protein, 18 aa, Homo sapiens
TEILSLEKPLLLHTGMGR

SEQ ID NO: 4954 - protein, 14 aa, Homo sapiens
TENLNDDEKLNNAK

SEQ ID NO: 4955 - protein, 7 aa, Homo sapiens
TESIIHR

SEQ ID NO: 4956 - protein, 20 aa, Homo sapiens
TESSTVTPTLPGETLTYVWK

SEQ ID NO: 4957 - protein, 21 aa, Homo sapiens
TETIEGVDAEDGHGPGEQQKR

SEQ ID NO: 4958 - protein, 24 aa, Homo sapiens
TETQEKNPLPSKETIEQEKQAGES

SEQ ID NO: 4959 - protein, 11 aa, Homo sapiens
TEVIPPLIENR

SEQ ID NO: 4960 - protein, 10 aa, Homo sapiens
TEVNVLPGAK

SEQ ID NO: 4961 - protein, 9 aa, Homo sapiens
TFAHYATFR

SEQ ID NO: 4962 - protein, 14 aa, Homo sapiens
TFAPEEISAMVLTK

SEQ ID NO: 4963 - protein, 6 aa, Homo sapiens
TFAQAR

SEQ ID NO: 4964 - protein, 17 aa, Homo sapiens
TFDKQIVLLFAVFDESK

SEQ ID NO: 4965 - protein, 11 aa, Homo sapiens
TFFFKDSQYWR

SEQ ID NO: 4966 - protein, 12 aa, Homo sapiens
TFGQGTKLEIKR

SEQ ID NO: 4967 - protein, 12 aa, Homo sapiens
TFGQGTKVEIKR

SEQ ID NO: 4968 - protein, 16 aa, Homo sapiens
TFHPLRSEAYNTFSER

SEQ ID NO: 4969 - protein, 17 aa, Homo sapiens
TFKDLHFLEELQLGHNR

SEQ ID NO: 4970 - protein, 12 aa, Homo sapiens
TFLDDASPGDKR

SEQ ID NO: 4971 - protein, 28 aa, Homo sapiens
TFSEWLESVKENPAVIDFELAPIVDLVR

SEQ ID NO: 4972 - protein, 11 aa, Homo sapiens
TFTKDSDKDLK

SEQ ID NO: 4973 - protein, 8 aa, Homo sapiens
TFTLLDPK

SEQ ID NO: 4974 - protein, 11 aa, Homo sapiens
TFTPQPPGLER

SEQ ID NO: 4975 - protein, 8 aa, Homo sapiens
TFVLNFIK

SEQ ID NO: 4976 - protein, 18 aa, Homo sapiens
TFVNITPAEVGVLVGKDR

SEQ ID NO: 4977 - protein, 8 aa, Homo sapiens
TGAQELLR

SEQ ID NO: 4978 - protein, 10 aa, Homo sapiens
TGAVSGHSLK

SEQ ID NO: 4979 - protein, 10 aa, Homo sapiens
TGDKVYVHLK

SEQ ID NO: 4980 - protein, 16 aa, Homo sapiens
TGEAVAEKDSEITFIK

SEQ ID NO: 4981 - protein, 17 aa, Homo sapiens
TGEAVAEKDSEITFIKK

SEQ ID NO: 4982 - protein, 16 aa, Homo sapiens
TGGLDLPSPPTGASLK

SEQ ID NO: 4983 - protein, 8 aa, Homo sapiens
TGHVIAVK

SEQ ID NO: 4984 - protein, 10 aa, Homo sapiens
TGISPLALIK

SEQ ID NO: 4985 - protein, 9 aa, Homo sapiens
TGIVSGFGR

SEQ ID NO: 4986 - protein, 13 aa, Homo sapiens
TGKPIKLTQVEHR

SEQ ID NO: 4987 - protein, 15 aa, Homo sapiens
TGLEAISNHKETEEK

SEQ ID NO: 4988 - protein, 27 aa, Homo sapiens
TGLLLLSDPDKVTIGLLFWDGRGEGLR

SEQ ID NO: 4989 - protein, 16 aa, Homo sapiens
TGSGDIENYNDATQVR

SEQ ID NO: 4990 - protein, 14 aa, Homo sapiens
TGTHGLLVKQEDMK

SEQ ID NO: 4991 - protein, 15 aa, Homo sapiens
TGVITSPDFPNPYPK

SEQ ID NO: 4992 - protein, 16 aa, Homo sapiens
TGWGNLKETWTANVGK

SEQ ID NO: 4993 - protein, 8 aa, Homo sapiens
TGWTQLSK

SEQ ID NO: 4994 - protein, 10 aa, Homo sapiens
THHDGAITER

SEQ ID NO: 4995 - protein, 13 aa, Homo sapiens
THLAPYSDELRQR

SEQ ID NO: 4996 - protein, 10 aa, Homo sapiens
THLPEVFLSK

SEQ ID NO: 4997 - protein, 16 aa, Homo sapiens
THNLEPYFESFINNLR

SEQ ID NO: 4998 - protein, 38 aa, Homo sapiens
TIHLTMPQLVLQGSYDLQDLLAQAELPAILHTELNLQK

SEQ ID NO: 4999 - protein, 16 aa, Homo sapiens
TIITTPPLKDFSLWEK

SEQ ID NO: 5000 - protein, 12 aa, Homo sapiens
TIKVPMMYGAGK

SEQ ID NO: 5001 - protein, 22 aa, Homo sapiens
TILDDLRAEDHFSVIDFNQNIR

SEQ ID NO: 5002 - protein, 8 aa, Homo sapiens
TINVPLRR

SEQ ID NO: 5003 - protein, 9 aa, Homo sapiens
TITKLSFVK

SEQ ID NO: 5004 - protein, 15 aa, Homo sapiens
TITKLSFVKVDSHFR

SEQ ID NO: 5005 - protein, 26 aa, Homo sapiens
TIVRFNRPFLMIIVPTDTQNIFFMSK

SEQ ID NO: 5006 - protein, 11 aa, Homo sapiens
TIVTTLQDSIR

SEQ ID NO: 5007 - protein, 12 aa, Homo sapiens
TIVTTLQDSIRK

SEQ ID NO: 5008 - protein, 16 aa, Homo sapiens
TKDSPVLIDFFEDTER

SEQ ID NO: 5009 - protein, 22 aa, Homo sapiens
TKGQPREPQVYTLPPSREEMTK

SEQ ID NO: 5010 - protein, 9 aa, Homo sapiens
TKNDFTWFK

SEQ ID NO: 5011 - protein, 13 aa, Homo sapiens
TKNSEEFAAAMSR

SEQ ID NO: 5012 - protein, 24 aa, Homo sapiens
TKTETITGFQVDAVPANGQTPIQR

SEQ ID NO: 5013 - protein, 8 aa, Homo sapiens
TKVFQLKR

SEQ ID NO: 5014 - protein, 18 aa, Homo sapiens
TLDEFTIIQNLQPQYQFR

SEQ ID NO: 5015 - protein, 9 aa, Homo sapiens
TLDGHMVVR

SEQ ID NO: 5016 - protein, 18 aa, Homo sapiens
TLDLGENQLETLPPDLLR

SEQ ID NO: 5017 - protein, 25 aa, Homo sapiens
TLDLGENQLETLPPDLLRGPLQLER

SEQ ID NO: 5018 - protein, 9 aa, Homo sapiens
TLEAQLTPR

SEQ ID NO: 5019 - protein, 22 aa, Homo sapiens
TLEIPGNSDPNMIPDGDFNSYV

SEQ ID NO: 5020 - protein, 23 aa, Homo sapiens
TLEIPGNSDPNMIPDGDFNSYVR

SEQ ID NO: 5021 - protein, 10 aa, Homo sapiens
TLIEKTNEER

SEQ ID NO: 5022 - protein, 11 aa, Homo sapiens
TLIEKTNEERK

SEQ ID NO: 5023 - protein, 16 aa, Homo sapiens
TLKIENVSYQDKGNYR

SEQ ID NO: 5024 - protein, 9 aa, Homo sapiens
TLLDIDNTR

SEQ ID NO: 5025 - protein, 11 aa, Homo sapiens
TLLLVGSPTWK

SEQ ID NO: 5026 - protein, 11 aa, Homo sapiens
TLLPVSKPEIR

SEQ ID NO: 5027 - protein, 11 aa, Homo sapiens
TLLSNLEEAKK

SEQ ID NO: 5028 - protein, 15 aa, Homo sapiens
TLNDMRQEYEQLIAK

SEQ ID NO: 5029 - protein, 27 aa, Homo sapiens
TLNLAQNLLAQLPEELFHPLTSLQTLK

SEQ ID NO: 5030 - protein, 24 aa, Homo sapiens
TLNQPDSQLQLTTGNGLFLSEGLK

SEQ ID NO: 5031 - protein, 17 aa, Homo sapiens
TLQALEFHTVPFQLLAR

SEQ ID NO: 5032 - protein, 6 aa, Homo sapiens
TLQELK

SEQ ID NO: 5033 - protein, 7 aa, Homo sapiens
TLQELKK

SEQ ID NO: 5034 - protein, 14 aa, Homo sapiens
TLQGIPQMIGEVIR

SEQ ID NO: 5035 - protein, 15 aa, Homo sapiens
TLQGIPQMIGEVIRK

SEQ ID NO: 5036 - protein, 30 aa, Homo sapiens
TLSLPELEQQQEQQQEQQQEQVQMLAPLES

SEQ ID NO: 5037 - protein, 10 aa, Homo sapiens
TLSPVLESPR

SEQ ID NO: 5038 - protein, 8 aa, Homo sapiens
TLVSGYPK

SEQ ID NO: 5039 - protein, 8 aa, Homo sapiens
TLYSSSPR

SEQ ID NO: 5040 - protein, 16 aa, Homo sapiens
TMEQFTIHLTVNPQSK

SEQ ID NO: 5041 - protein, 12 aa, Homo sapiens
TMFIGGSQLSQK

SEQ ID NO: 5042 - protein, 16 aa, Homo sapiens
TMLLQPAGSLGSYSYR

SEQ ID NO: 5043 - protein, 11 aa, Homo sapiens
TMQENSTPRED

SEQ ID NO: 5044 - protein, 12 aa, Homo sapiens
TNAENEFVTIKK

SEQ ID NO: 5045 - protein, 11 aa, Homo sapiens
TNFDNDIALVR

SEQ ID NO: 5046 - protein, 7 aa, Homo sapiens
TNIKEYK

SEQ ID NO: 5047 - protein, 18 aa, Homo sapiens
TNIKEYKDSFSNEKFDFR

SEQ ID NO: 5048 - protein, 7 aa, Homo sapiens
TNNHIMK

SEQ ID NO: 5049 - protein, 12 aa, Homo sapiens
TNQVNSGGVLLR

SEQ ID NO: 5050 - protein, 16 aa, Homo sapiens
TNSPELEETLTHTITK

SEQ ID NO: 5051 - protein, 24 aa, Homo sapiens
TNVLLSPLSVATALSALSLGAEQR

SEQ ID NO: 5052 - protein, 7 aa, Homo sapiens
TPALHFK

SEQ ID NO: 5053 - protein, 8 aa, Homo sapiens
TPDFQLFK

SEQ ID NO: 5054 - protein, 21 aa, Homo sapiens
TPDVSSALDKLKEFGNTLEDK

SEQ ID NO: 5055 - protein, 23 aa, Homo sapiens
TPDVSSALDKLKEFGNTLEDKAR

SEQ ID NO: 5056 - protein, 10 aa, Homo sapiens
TPEGLTLLFK

SEQ ID NO: 5057 - protein, 12 aa, Homo sapiens
TPEHVFIHPGWK

SEQ ID NO: 5058 - protein, 22 aa, Homo sapiens
TPEPRPSLSHLLSQYYGAGVAR

SEQ ID NO: 5059 - protein, 27 aa, Homo sapiens
TPEPRPSLSHLLSQYYGAGVARDPGFR

SEQ ID NO: 5060 - protein, 9 aa, Homo sapiens
TPEYYPNAG

SEQ ID NO: 5061 - protein, 16 aa, Homo sapiens
TPGAAANLELIFVGPQ

SEQ ID NO: 5062 - protein, 21 aa, Homo sapiens
TPGAAANLELIFVGPQHAGNY

SEQ ID NO: 5063 - protein, 22 aa, Homo sapiens
TPGAAANLELIFVGPQHAGNYR

SEQ ID NO: 5064 - protein, 8 aa, Homo sapiens
TPGIWLLH

SEQ ID NO: 5065 - protein, 6 aa, Homo sapiens
TPITFR

SEQ ID NO: 5066 - protein, 7 aa, Homo sapiens
TPITVVK

SEQ ID NO: 5067 - protein, 26 aa, Homo sapiens
TPLPPTSAHGNVAEGETKPDPDVTER

SEQ ID NO: 5068 - protein, 10 aa, Homo sapiens
TPNSVWEPAK

SEQ ID NO: 5069 - protein, 26 aa, Homo sapiens
TPSAAYLWVGTGASEAEKTGAQELLR

SEQ ID NO: 5070 - protein, 10 aa, Homo sapiens
TPWHVTIKPK

SEQ ID NO: 5071 - protein, 10 aa, Homo sapiens
TPYADEFKVK

SEQ ID NO: 5072 - protein, 17 aa, Homo sapiens
TQEKLNHQLEGLTFQMK

SEQ ID NO: 5073 - protein, 10 aa, Homo sapiens
TQGSSGYSLR

SEQ ID NO: 5074 - protein, 10 aa, Homo sapiens
TQIDSPLSGK

SEQ ID NO: 5075 - protein, 10 aa, Homo sapiens
TQILEWAAER

SEQ ID NO: 5076 - protein, 13 aa, Homo sapiens
TQPPSVSGAPGQR

SEQ ID NO: 5077 - protein, 17 aa, Homo sapiens
TQSGLQSYLLQFHGLVR

SEQ ID NO: 5078 - protein, 14 aa, Homo sapiens
TQSSDGKAQMQSPA

SEQ ID NO: 5079 - protein, 8 aa, Homo sapiens
TQVADAKR

SEQ ID NO: 5080 - protein, 8 aa, Homo sapiens
TQVLHFTK

SEQ ID NO: 5081 - protein, 11 aa, Homo sapiens
TQVNTQAEQLR

SEQ ID NO: 5082 - protein, 12 aa, Homo sapiens
TQVNTQAEQLRR

SEQ ID NO: 5083 - protein, 16 aa, Homo sapiens
TRDRLDEVKEQVAEVR

SEQ ID NO: 5084 - protein, 20 aa, Homo sapiens
TRHTASAWLMSAPNSGPHNR

SEQ ID NO: 5085 - protein, 8 aa, Homo sapiens
TRIQDLNR

SEQ ID NO: 5086 - protein, 9 aa, Homo sapiens
TRMEPFHFK

SEQ ID NO: 5087 - protein, 13 aa, Homo sapiens
TSAGTRQPQFISR

SEQ ID NO: 5088 - protein, 21 aa, Homo sapiens
TSAHGNVAEGETKPDPDVTER

SEQ ID NO: 5089 - protein, 7 aa, Homo sapiens
TSALSAK

SEQ ID NO: 5090 - protein, 11 aa, Homo sapiens
TSDQIHFFFAK

SEQ ID NO: 5091 - protein, 22 aa, Homo sapiens
TSESGELHGLTTEEEFVEGIYK

SEQ ID NO: 5092 - protein, 32 aa, Homo sapiens; identical to SEQ ID NO: 1342

SEQ ID NO: 5093 - protein, 10 aa, Homo sapiens
TSESGLPSTR

SEQ ID NO: 5094 - protein, 14 aa, Homo sapiens
TSIDFPDETLSFIK

SEQ ID NO: 5095 - protein, 17 aa, Homo sapiens
TSIYPFLDFMPSPQVVR

SEQ ID NO: 5096 - protein, 12 aa, Homo sapiens
TSLEDFYLDEER

SEQ ID NO: 5097 - protein, 13 aa, Homo sapiens
TSLVIENEAGDER

SEQ ID NO: 5098 - protein, 11 aa, Homo sapiens
TSNFNAAISLK

SEQ ID NO: 5099 - protein, 19 aa, Homo sapiens
TSPVDEKALQDQLVLVAAK

SEQ ID NO: 5100 - protein, 27 aa, Homo sapiens
TSPVDEKALQDQLVLVAAKLDTEDKLR

SEQ ID NO: 5101 - protein, 24 aa, Homo sapiens
TSSFALNLPTLPEVKFPEVDVLTK

SEQ ID NO: 5102 - protein, 8 aa, Homo sapiens
TSSSFEVR

SEQ ID NO: 5103 - protein, 8 aa, Homo sapiens
TSYQVYSK

SEQ ID NO: 5104 - protein, 11 aa, Homo sapiens
TTAKENYDNAK

SEQ ID NO: 5105 - protein, 12 aa, Homo sapiens
TTDVTQTFGIEK

SEQ ID NO: 5106 - protein, 7 aa, Homo sapiens
TTFDPKK

SEQ ID NO: 5107 - protein, 30 aa, Homo sapiens
TTGIVMDSGDGVTHTVPIYEGYALPHAILR

SEQ ID NO: 5108 - protein, 17 aa, Homo sapiens
TTIEKPVWLGFLGPIIK

SEQ ID NO: 5109 - protein, 7 aa, Homo sapiens
TTMIQSK

SEQ ID NO: 5110 - protein, 14 aa, Homo sapiens
TTNIQGINLLFSSR

SEQ ID NO: 5111 - protein, 15 aa, Homo sapiens
TTPKDFYVDENTTVR

SEQ ID NO: 5112 - protein, 12 aa, Homo sapiens
TTSAKETQSIEK

SEQ ID NO: 5113 - protein, 8 aa, Homo sapiens
TTSGIHPK

SEQ ID NO: 5114 - protein, 6 aa, Homo sapiens
TTVMVK

SEQ ID NO: 5115 - protein, 13 aa, Homo sapiens
TTWDYASDHGEKK

SEQ ID NO: 5116 - protein, 18 aa, Homo sapiens
TVAAPSVFIFPPSDEQLK

SEQ ID NO: 5117 - protein, 7 aa, Homo sapiens
TVEVPFK

SEQ ID NO: 5118 - protein, 20 aa, Homo sapiens
TVFGTEPDMIRDGSTIPIAK

SEQ ID NO: 5119 - protein, 11 aa, Homo sapiens
TVGSDTFYSFK

SEQ ID NO: 5120 - protein, 15 aa, Homo sapiens
TVGSDTFYSFKYEIK

SEQ ID NO: 5121 - protein, 13 aa, Homo sapiens
TVGSLAGQPLQER

SEQ ID NO: 5122 - protein, 12 aa, Homo sapiens
TVHFHGHSFQYK

SEQ ID NO: 5123 - protein, 8 aa, Homo sapiens
TVIEVDER

SEQ ID NO: 5124 - protein, 23 aa, Homo sapiens
TVITADFDNDQELEIFFNNIAYR

SEQ ID NO: 5125 - protein, 12 aa, Homo sapiens
TVMPYISTTPAK

SEQ ID NO: 5126 - protein, 10 aa, Homo sapiens
TVQAVLTVPK

SEQ ID NO: 5127 - protein, 11 aa, Homo sapiens
TVRVPMMSDPK

SEQ ID NO: 5128 - protein, 19 aa, Homo sapiens
TVSEALLMEPTDDGNTTPR

SEQ ID NO: 5129 - protein, 12 aa, Homo sapiens
TVTHTDLPSPLK

SEQ ID NO: 5130 - protein, 11 aa, Homo sapiens
TVWSAHSGPTR

SEQ ID NO: 5131 - protein, 25 aa, Homo sapiens
TWDPEGVIFYGDTNPKDDWFMLGLR

SEQ ID NO: 5132 - protein, 11 aa, Homo sapiens
TWDYASDHGEK

SEQ ID NO: 5133 - protein, 12 aa, Homo sapiens
TWNDPSVQQDIK

SEQ ID NO: 5134 - protein, 14 aa, Homo sapiens
TWPHFTATVKPRPA

SEQ ID NO: 5135 - protein, 11 aa, Homo sapiens
TWRNDLISATK

SEQ ID NO: 5136 - protein, 10 aa, Homo sapiens
TWSGAVLAGR

SEQ ID NO: 5137 - protein, 7 aa, Homo sapiens
TYATYPK

SEQ ID NO: 5138 - protein, 10 aa, Homo sapiens
TYHVGEQWQK

SEQ ID NO: 5139 - protein, 11 aa, Homo sapiens
TYIFAGDKFWR

SEQ ID NO: 5140 - protein, 16 aa, Homo sapiens
TYLPAVDEKLRDLYSK

SEQ ID NO: 5141 - protein, 8 aa, Homo sapiens
TYNVLDMK

SEQ ID NO: 5142 - protein, 21 aa, Homo sapiens
TYSDHPEKVNKDDEEFIESNK

SEQ ID NO: 5143 - protein, 28 aa, Homo sapiens
TYSDHPEKVNKDDEEFIESNKMHAINGR

SEQ ID NO: 5144 - protein, 12 aa, Homo sapiens
TYTSQEDLVEKK

SEQ ID NO: 5145 - protein, 7 aa, Homo sapiens
VAAEDWK

SEQ ID NO: 5146 - protein, 10 aa, Homo sapiens
VAAGAFQGLR

SEQ ID NO: 5147 - protein, 15 aa, Homo sapiens
VAEGETKPDPDVTER

SEQ ID NO: 5148 - protein, 17 aa, Homo sapiens
VAEGSEPDGFWEALGGK

SEQ ID NO: 5149 - protein, 11 aa, Homo sapiens
VAEYMDWILEK

SEQ ID NO: 5150 - protein, 16 aa, Homo sapiens
VAGLLEDTFPGLLGLR

SEQ ID NO: 5151 - protein, 8 aa, Homo sapiens
VANPLSTA

SEQ ID NO: 5152 - protein, 14 aa, Homo sapiens
VANYFDWISYHVGR

SEQ ID NO: 5153 - protein, 22 aa, Homo sapiens
VANYFDWISYHVGRPFISQYNV

SEQ ID NO: 5154 - protein, 11 aa, Homo sapiens
VANYVDWINDR

SEQ ID NO: 5155 - protein, 18 aa, Homo sapiens
VAPEEHPVLLTEAPLNPK

SEQ ID NO: 5156 - protein, 14 aa, Homo sapiens
VAQEPVHLDSPAIK

SEQ ID NO: 5157 - protein, 23 aa, Homo sapiens
VAQVIIPSTYVPGTTNHDIALLR

SEQ ID NO: 5158 - protein, 9 aa, Homo sapiens
VASYGVKPR

SEQ ID NO: 5159 - protein, 12 aa, Homo sapiens
VAVIVSNDHAGK

SEQ ID NO: 5160 - protein, 19 aa, Homo sapiens
VAVVEYHDGSHAYIGLKDR

SEQ ID NO: 5161 - protein, 9 aa, Homo sapiens
VAVVQYSDR

SEQ ID NO: 5162 - protein, 16 aa, Homo sapiens
VAVVQYSGTGQQRPER

SEQ ID NO: 5163 - protein, 7 aa, Homo sapiens
VDAALKK

SEQ ID NO: 5164 - protein, 12 aa, Homo sapiens
VDEFVGMLDMLR

SEQ ID NO: 5165 - protein, 24 aa, Homo sapiens
VDFTLSSERDFALLSLQVPLKDAK

SEQ ID NO: 5166 - protein, 13 aa, Homo sapiens
VDKDNEDFQESNR

SEQ ID NO: 5167 - protein, 19 aa, Homo sapiens
VDLSFSPSQSLPASHAHLR

SEQ ID NO: 5168 - protein, 20 aa, Homo sapiens
VDNALQSGNSQESVTEQDSK

SEQ ID NO: 5169 - protein, 34 aa, Homo sapiens; identical to SEQ ID NO: 1209

SEQ ID NO: 5170 - protein, 39 aa, Homo sapiens
VDNALQSGNSQESVTEQDSKDSTYSLSSTLTLSKADYEK

SEQ ID NO: 5171 - protein, 13 aa, Homo sapiens
VDRPFLFLIYEHR

SEQ ID NO: 5172 - protein, 10 aa, Homo sapiens
VDTVDPPYPR

SEQ ID NO: 5173 - protein, 14 aa, Homo sapiens
VEDPESTLFGSVIR

SEQ ID NO: 5174 - protein, 27 aa, Homo sapiens
VEKFDLVPVPTNLYGDFFTGDAYVILK

SEQ ID NO: 5175 - protein, 10 aa, Homo sapiens
VEPYGENFNK

SEQ ID NO: 5176 - protein, 8 aa, Homo sapiens
VEYGFQVK

SEQ ID NO: 5177 - protein, 15 aa, Homo sapiens
VFAIPPSFASIFLTK

SEQ ID NO: 5178 - protein, 7 aa, Homo sapiens
VFALDQK

SEQ ID NO: 5179 - protein, 8 aa, Homo sapiens
VFAVSHGR

SEQ ID NO: 5180 - protein, 6 aa, Homo sapiens
VFGALK

SEQ ID NO: 5181 - protein, 7 aa, Homo sapiens
VFGGGTK

SEQ ID NO: 5182 - protein, 17 aa, Homo sapiens
VFKDVFLEMNIPYSVVR

SEQ ID NO: 5183 - protein, 24 aa, Homo sapiens
VFKDVFLEMNIPYSVVRGEQIQLK

SEQ ID NO: 5184 - protein, 12 aa, Homo sapiens
VFKTDMELEVLR

SEQ ID NO: 5185 - protein, 7 aa, Homo sapiens
VFQFLEK

SEQ ID NO: 5186 - protein, 12 aa, Homo sapiens
VFQQVAQASKDR

SEQ ID NO: 5187 - protein, 17 aa, Homo sapiens
VFQYIDLHQDEFVQTLK

SEQ ID NO: 5188 - protein, 32 aa, Homo sapiens
VFQYIDLHQDEFVQTLKEWVAIESDSVQPVPR

SEQ ID NO: 5189 - protein, 10 aa, Homo sapiens
VFREFHLHLR

SEQ ID NO: 5190 - protein, 11 aa, Homo sapiens
VFSGDGKDFYR

SEQ ID NO: 5191 - protein, 10 aa, Homo sapiens
VFSLQWGEVK

SEQ ID NO: 5192 - protein, 18 aa, Homo sapiens
VFSNGADLSGVTEEAPLK

SEQ ID NO: 5193 - protein, 11 aa, Homo sapiens
VGAHTLGHNSR

SEQ ID NO: 5194 - protein, 23 aa, Homo sapiens
VGDRNTEQEEGGEAVHEVEVVIK

SEQ ID NO: 5195 - protein, 26 aa, Homo sapiens
VGDRNTEQEEGGEAVHEVEVVIKHNR

SEQ ID NO: 5196 - protein, 10 aa, Homo sapiens
VGDTLNLNLR

SEQ ID NO: 5197 - protein, 9 aa, Homo sapiens
VGDTYERPK

SEQ ID NO: 5198 - protein, 11 aa, Homo sapiens
VGEFSGANKEK

SEQ ID NO: 5199 - protein, 6 aa, Homo sapiens
VGEVLK

SEQ ID NO: 5200 - protein, 12 aa, Homo sapiens
VGLSDAFVVVHR

SEQ ID NO: 5201 - protein, 21 aa, Homo sapiens
VGLSGMAIADVTLLSGFHALR

SEQ ID NO: 5202 - protein, 12 aa, Homo sapiens
VGSALFLSHNLK

SEQ ID NO: 5203 - protein, 17 aa, Homo sapiens
VGSPNAAVLWLWSSHNR

SEQ ID NO: 5204 - protein, 14 aa, Homo sapiens
VGYVSGWGQSDNFK

SEQ ID NO: 5205 - protein, 14 aa, Homo sapiens
VHDVNDNWPVFTHR

SEQ ID NO: 5206 - protein, 16 aa, Homo sapiens
VHSGRGAGAESSHPVR

SEQ ID NO: 5207 - protein, 17 aa, Homo sapiens
VHVSEEGTEPEAMLQVL

SEQ ID NO: 5208 - protein, 20 aa, Homo sapiens
VHVSEEGTEPEAMLQVLGPK

SEQ ID NO: 5209 - protein, 38 aa, Homo sapiens
VHVSEEGTEPEAMLQVLGPKPALPAGTEDTAKEDAANR

SEQ ID NO: 5210 - protein, 39 aa, Homo sapiens
VHVSEEGTEPEAMLQVLGPKPALPAGTEDTAKEDAANRK

SEQ ID NO: 5211 - protein, 9 aa, Homo sapiens
VIAVNEVGR

SEQ ID NO: 5212 - protein, 6 aa, Homo sapiens
VIDAVR

SEQ ID NO: 5213 - protein, 17 aa, Homo sapiens
VIGNMGQTMEQLTPELK

SEQ ID NO: 5214 - protein, 22 aa, Homo sapiens
VILGAHQEVNLEPHVQEIEVSR

SEQ ID NO: 5215 - protein, 17 aa, Homo sapiens
VIPGPPALTLVPAELVR

SEQ ID NO: 5216 - protein, 8 aa, Homo sapiens
VIQTAFQR

SEQ ID NO: 5217 - protein, 15 aa, Homo sapiens
VIVIPVGIGPHANLK

SEQ ID NO: 5218 - protein, 11 aa, Homo sapiens
VKDISEVVTPR

SEQ ID NO: 5219 - protein, 13 aa, Homo sapiens
VKDMENLEDVFYQ

SEQ ID NO: 5220 - protein, 7 aa, Homo sapiens
VKENFDK

SEQ ID NO: 5221 - protein, 9 aa, Homo sapiens
VKENFDKAR

SEQ ID NO: 5222 - protein, 10 aa, Homo sapiens
VKIDQTVEEL

SEQ ID NO: 5223 - protein, 11 aa, Homo sapiens
VKIDQTVEELR

SEQ ID NO: 5224 - protein, 12 aa, Homo sapiens
VKIDQTVEELRR

SEQ ID NO: 5225 - protein, 10 aa, Homo sapiens
VKNYVDWIMK

SEQ ID NO: 5226 - protein, 11 aa, Homo sapiens
VKSPELQAEAK

SEQ ID NO: 5227 - protein, 22 aa, Homo sapiens
VKVEPLYELVTATDFAYSSTVR

SEQ ID NO: 5228 - protein, 27 aa, Homo sapiens
VKWYLFGMGNEVDVHAAFFHGQALTNK

SEQ ID NO: 5229 - protein, 13 aa, Homo sapiens
VLAKPQNTAEVQK

SEQ ID NO: 5230 - protein, 9 aa, Homo sapiens
VLDALQAIK

SEQ ID NO: 5231 - protein, 20 aa, Homo sapiens
VLDAVRGSPAINVAVHVFRK

SEQ ID NO: 5232 - protein, 6 aa, Homo sapiens
VLDLTR

SEQ ID NO: 5233 - protein, 18 aa, Homo sapiens
VLDVFEEGTEASAATAVK

SEQ ID NO: 5234 - protein, 10 aa, Homo sapiens
VLEKDSVTLK

SEQ ID NO: 5235 - protein, 7 aa, Homo sapiens
VLEPTLK

SEQ ID NO: 5236 - protein, 11 aa, Homo sapiens
VLFYVDSEKLK

SEQ ID NO: 5237 - protein, 21 aa, Homo sapiens
VLFYVDSEKLKQNDFNSVEEK

SEQ ID NO: 5238 - protein, 22 aa, Homo sapiens
VLFYVDSEKLKQNDFNSVEEKK

SEQ ID NO: 5239 - protein, 7 aa, Homo sapiens
VLGQVNK

SEQ ID NO: 5240 - protein, 17 aa, Homo sapiens
VLLESIGSHEELTQDSR

SEQ ID NO: 5241 - protein, 11 aa, Homo sapiens
VLMSVLNDNSR

SEQ ID NO: 5242 - protein, 10 aa, Homo sapiens
VLNTEANVVR

SEQ ID NO: 5243 - protein, 11 aa, Homo sapiens
VLNTEANVVRK

SEQ ID NO: 5244 - protein, 9 aa, Homo sapiens
VLNYVDWIK

SEQ ID NO: 5245 - protein, 10 aa, Homo sapiens
VLNYVDWIKK

SEQ ID NO: 5246 - protein, 16 aa, Homo sapiens
VLNYVDWIKKEMEEED

SEQ ID NO: 5247 - protein, 6 aa, Homo sapiens
VLQIEK

SEQ ID NO: 5248 - protein, 12 aa, Homo sapiens
VLQIEKEGAIHR

SEQ ID NO: 5249 - protein, 24 aa, Homo sapiens
VLQIEKEGAIHREELVYELNPLDH

SEQ ID NO: 5250 - protein, 25 aa, Homo sapiens
VLQIEKEGAIHREELVYELNPLDHR

SEQ ID NO: 5251 - protein, 26 aa, Homo sapiens
VLQIEKEGAIHREELVYELNPLDHRG

SEQ ID NO: 5252 - protein, 18 aa, Homo sapiens
VLRENADSLQASLRPHAD

SEQ ID NO: 5253 - protein, 21 aa, Homo sapiens
VLRENADSLQASLRPHADELK

SEQ ID NO: 5254 - protein, 23 aa, Homo sapiens
VLRENADSLQASLRPHADELKAK

SEQ ID NO: 5255 - protein, 17 aa, Homo sapiens
VLSALQAVQGLLVAQGR

SEQ ID NO: 5256 - protein, 15 aa, Homo sapiens
VLSLAQEQVGGSPEK

SEQ ID NO: 5257 - protein, 9 aa, Homo sapiens
VLSYVDWIK

SEQ ID NO: 5258 - protein, 7 aa, Homo sapiens
VLTGNPR

SEQ ID NO: 5259 - protein, 8 aa, Homo sapiens
VLVENEHR

SEQ ID NO: 5260 - protein, 11 aa, Homo sapiens
VMDKYTFELSR

SEQ ID NO: 5261 - protein, 13 aa, Homo sapiens
VMTPAVYAPYDVK

SEQ ID NO: 5262 - protein, 7 aa, Homo sapiens
VNAWQAK

SEQ ID NO: 5263 - protein, 8 aa, Homo sapiens
VNDAQEYR

SEQ ID NO: 5264 - protein, 13 aa, Homo sapiens
VNDESTEGKTSYR

SEQ ID NO: 5265 - protein, 13 aa, Homo sapiens
VNFLASNIHYPSK

SEQ ID NO: 5266 - protein, 14 aa, Homo sapiens
VNFLASNIHYPSKK

SEQ ID NO: 5267 - protein, 11 aa, Homo sapiens
VNGQSHISLSK

SEQ ID NO: 5268 - protein, 16 aa, Homo sapiens
VNGVLTALPVSVADGR

SEQ ID NO: 5269 - protein, 13 aa, Homo sapiens
VNKDDEEFIESNK

SEQ ID NO: 5270 - protein, 20 aa, Homo sapiens
VNKDDEEFIESNKMHAINGR

SEQ ID NO: 5271 - protein, 24 aa, Homo sapiens
VNRNNLELSTPLKIETISHEDLQR

SEQ ID NO: 5272 - protein, 9 aa, Homo sapiens
VNSFFSTFK

SEQ ID NO: 5273 - protein, 11 aa, Homo sapiens
VNSFFSTFKEK

SEQ ID NO: 5274 - protein, 16 aa, Homo sapiens
VNSFFSTFKEKESQDK

SEQ ID NO: 5275 - protein, 18 aa, Homo sapiens
VPEARPNSMVVEHPEFLK

SEQ ID NO: 5276 - protein, 10 aa, Homo sapiens
VPFATELHER

SEQ ID NO: 5277 - protein, 28 aa, Homo sapiens
VPFDAATLHTSTAMAAQHGMDDDGTGQK

SEQ ID NO: 5278 - protein, 22 aa, Homo sapiens
VPGDQTSTIIQELEPGVEYFIR

SEQ ID NO: 5279 - protein, 14 aa, Homo sapiens
VPGLYYFTYHASSR

SEQ ID NO: 5280 - protein, 17 aa, Homo sapiens
VPMMLQDQEHHWYLHDR

SEQ ID NO: 5281 - protein, 8 aa, Homo sapiens
VPMMSDPK

SEQ ID NO: 5282 - protein, 13 aa, Homo sapiens
VPPPRDFHINLFR

SEQ ID NO: 5283 - protein, 12 aa, Homo sapiens
VPPRDGFFGNPR

SEQ ID NO: 5284 - protein, 20 aa, Homo sapiens
VPSYTLILPSLELPVLHVPR

SEQ ID NO: 5285 - protein, 22 aa, Homo sapiens
VPTADLEDVLPLAEDITNILSK

SEQ ID NO: 5286 - protein, 17 aa, Homo sapiens
VQAAVGTSAAPVPSDNH

SEQ ID NO: 5287 - protein, 16 aa, Homo sapiens
VQEAHLTEDQIFYFPK

SEQ ID NO: 5288 - protein, 8 aa, Homo sapiens
VQEIEVSR

SEQ ID NO: 5289 - protein, 11 aa, Homo sapiens
VQFELHYQEVK

SEQ ID NO: 5290 - protein, 11 aa, Homo sapiens
VQLVAHSPWLK

SEQ ID NO: 5291 - protein, 10 aa, Homo sapiens
VQPYLDDFQK

SEQ ID NO: 5292 - protein, 11 aa, Homo sapiens
VQPYLDDFQKK

SEQ ID NO: 5293 - protein, 8 aa, Homo sapiens
VQQMEQLR

SEQ ID NO: 5294 - protein, 8 aa, Homo sapiens
VQSTITSR

SEQ ID NO: 5295 - protein, 24 aa, Homo sapiens
VQSWKGSLVQASEANLQAAQDFVR

SEQ ID NO: 5296 - protein, 7 aa, Homo sapiens
VQVVAGK

SEQ ID NO: 5297 - protein, 8 aa, Homo sapiens
VQVVAGKK

SEQ ID NO: 5298 - protein, 38 aa, Homo sapiens; identical to SEQ ID NO: 1256

SEQ ID NO: 5299 - protein, 32 aa, Homo sapiens; identical to SEQ ID NO: 2028

SEQ ID NO: 5300 - protein, 22 aa, Homo sapiens
VREYYFAEAQIADFSDPAFISK

SEQ ID NO: 5301 - protein, 16 aa, Homo sapiens
VRGGEGTGYFVDFSVR

SEQ ID NO: 5302 - protein, 8 aa, Homo sapiens
VRPQQLVK

SEQ ID NO: 5303 - protein, 15 aa, Homo sapiens
VRVYSLNDDLKPAKR

SEQ ID NO: 5304 - protein, 12 aa, Homo sapiens
VSAQQVQGVHAR

SEQ ID NO: 5305 - protein, 12 aa, Homo sapiens
VSDPKFHPLHSK

SEQ ID NO: 5306 - protein, 14 aa, Homo sapiens
VSEADSSNADWVTK

SEQ ID NO: 5307 - protein, 10 aa, Homo sapiens
VSEALGQGTR

SEQ ID NO: 5308 - protein, 12 aa, Homo sapiens
VSEGNHDIALIK

SEQ ID NO: 5309 - protein, 13 aa, Homo sapiens
VSFLSALEEYTKK

SEQ ID NO: 5310 - protein, 12 aa, Homo sapiens
VSGFIPLKPTVK

SEQ ID NO: 5311 - protein, 9 aa, Homo sapiens
VSHEHLLQR

SEQ ID NO: 5312 - protein, 14 aa, Homo sapiens
VSLGSPSGEVSHPR

SEQ ID NO: 5313 - protein, 7 aa, Homo sapiens
VSMMQTK

SEQ ID NO: 5314 - protein, 18 aa, Homo sapiens
VSSAMEPDREYHFGQAVR

SEQ ID NO: 5315 - protein, 9 aa, Homo sapiens
VSTAFVYTK

SEQ ID NO: 5316 - protein, 8 aa, Homo sapiens
VSTEVDAR

SEQ ID NO: 5317 - protein, 16 aa, Homo sapiens
VSTISLPTAPPATGTK

SEQ ID NO: 5318 - protein, 10 aa, Homo sapiens
VSVFVDWIHK

SEQ ID NO: 5319 - protein, 16 aa, Homo sapiens
VSVFVPPRDGFFGNPR

SEQ ID NO: 5320 - protein, 8 aa, Homo sapiens
VSVGGEKR

SEQ ID NO: 5321 - protein, 26 aa, Homo sapiens
VTASDPLDTLGSEGALSPGGVASLLR

SEQ ID NO: 5322 - protein, 14 aa, Homo sapiens
VTDATETTITISWR

SEQ ID NO: 5323 - protein, 11 aa, Homo sapiens
VTEIWQEVMQR

SEQ ID NO: 5324 - protein, 15 aa, Homo sapiens
VTEPISAESGEQVER

SEQ ID NO: 5325 - protein, 13 aa, Homo sapiens
VTFELTYEELLKR

SEQ ID NO: 5326 - protein, 19 aa, Homo sapiens
VTFHNKGAYPLSIEPIGVR

SEQ ID NO: 5327 - protein, 13 aa, Homo sapiens
VTFQLTYEEVLKR

SEQ ID NO: 5328 - protein, 10 aa, Homo sapiens
VTGHNSPLYK

SEQ ID NO: 5329 - protein, 17 aa, Homo sapiens
VTGWGNLKETWTANVGK

SEQ ID NO: 5330 - protein, 11 aa, Homo sapiens
VTIDSSYDIAK

SEQ ID NO: 5331 - protein, 14 aa, Homo sapiens
VTLNGVPAQPLGPR

SEQ ID NO: 5332 - protein, 8 aa, Homo sapiens
VTQAEGAK

SEQ ID NO: 5333 - protein, 13 aa, Homo sapiens
VTTSQDMLSIMEK

SEQ ID NO: 5334 - protein, 23 aa, Homo sapiens
VTTVASHTSDSDVPSGVTEVVVK

SEQ ID NO: 5335 - protein, 18 aa, Homo sapiens
VTVFPIGIGDRYDAAQLR

SEQ ID NO: 5336 - protein, 17 aa, Homo sapiens
VTWAPPPSIDLTNFLVR

SEQ ID NO: 5337 - protein, 9 aa, Homo sapiens
VTYDVSRDK

SEQ ID NO: 5338 - protein, 8 aa, Homo sapiens
VTYLQNGK

SEQ ID NO: 5339 - protein, 13 aa, Homo sapiens
VTYTSQEDLVEKK

SEQ ID NO: 5340 - protein, 19 aa, Homo sapiens
VVAQGVGIPEDSIFTMADR

SEQ ID NO: 5341 - protein, 20 aa, Homo sapiens
VVEEPNAFGVNNPFLPQASR

SEQ ID NO: 5342 - protein, 9 aa, Homo sapiens
VVEESELAR

SEQ ID NO: 5343 - protein, 11 aa, Homo sapiens
VVESLDVGQDR

SEQ ID NO: 5344 - protein, 16 aa, Homo sapiens
VVGGHPGNSPWTVSLR

SEQ ID NO: 5345 - protein, 9 aa, Homo sapiens
VVGGLVALR

SEQ ID NO: 5346 - protein, 23 aa, Homo sapiens
VVGLIQDLKPNTIMVLVNYIHFK

SEQ ID NO: 5347 - protein, 11 aa, Homo sapiens
VVHAGEDDLGR

SEQ ID NO: 5348 - protein, 22 aa, Homo sapiens
VVLGDQDLKKEEFHEQSFRVEK

SEQ ID NO: 5349 - protein, 8 aa, Homo sapiens
VVLSQGSK

SEQ ID NO: 5350 - protein, 24 aa, Homo sapiens
VVLSSGSGPGLDLPLVLGLPLQLK

SEQ ID NO: 5351 - protein, 7 aa, Homo sapiens
VVLYTKK

SEQ ID NO: 5352 - protein, 8 aa, Homo sapiens
VVMYEGKK

SEQ ID NO: 5353 - protein, 19 aa, Homo sapiens
VVNNSPQPQNVVFDVQIPK

SEQ ID NO: 5354 - protein, 7 aa, Homo sapiens
VVNPTEA

SEQ ID NO: 5355 - protein, 18 aa, Homo sapiens
VVPVRLDLTEKDYEILFK

SEQ ID NO: 5356 - protein, 23 aa, Homo sapiens
VVQGKEPAHLMSLFGGKPMIIYK

SEQ ID NO: 5357 - protein, 24 aa, Homo sapiens
VVSMDENFHPLNELIPLVYIQDPK

SEQ ID NO: 5358 - protein, 19 aa, Homo sapiens
VVSVLTVLHQDWLNGKEYK

SEQ ID NO: 5359 - protein, 8 aa, Homo sapiens
VVVHPDYR

SEQ ID NO: 5360 - protein, 12 aa, Homo sapiens
VWFELTQGSITK

SEQ ID NO: 5361 - protein, 13 aa, Homo sapiens
VWFELTQGSITKR

SEQ ID NO: 5362 - protein, 9 aa, Homo sapiens
VWVYPPEKK

SEQ ID NO: 5363 - protein, 10 aa, Homo sapiens
VYELNPLDHR

SEQ ID NO: 5364 - protein, 8 aa, Homo sapiens
VYFAGFPR

SEQ ID NO: 5365 - protein, 24 aa, Homo sapiens
VYLIYGNDLGLPPVDLDLDKEAHR

SEQ ID NO: 5366 - protein, 13 aa, Homo sapiens
VYSLNDDLKPAKR

SEQ ID NO: 5367 - protein, 7 aa, Homo sapiens
VYVYNGK

SEQ ID NO: 5368 - protein, 9 aa, Homo sapiens
WADLSGITK

SEQ ID NO: 5369 - protein, 9 aa, Homo sapiens
WAEVGDTIR

SEQ ID NO: 5370 - protein, 10 aa, Homo sapiens
WDAQIPHQHR

SEQ ID NO: 5371 - protein, 10 aa, Homo sapiens
WDEELAAFAK

SEQ ID NO: 5372 - protein, 13 aa, Homo sapiens
WDIMISNHQNSNR

SEQ ID NO: 5373 - protein, 9 aa, Homo sapiens
WDRELISER

SEQ ID NO: 5374 - protein, 11 aa, Homo sapiens
WDYASDHGEKK

SEQ ID NO: 5375 - protein, 10 aa, Homo sapiens
WEAEPVYVQR

SEQ ID NO: 5376 - protein, 8 aa, Homo sapiens
WEAPKEHK

SEQ ID NO: 5377 - protein, 13 aa, Homo sapiens
WEDILSDEVNVAR

SEQ ID NO: 5378 - protein, 9 aa, Homo sapiens
WEKPFISSR

SEQ ID NO: 5379 - protein, 14 aa, Homo sapiens
WEMPFDPQDTHQSR

SEQ ID NO: 5380 - protein, 17 aa, Homo sapiens
WFLLEQPEIQVAHFPFK

SEQ ID NO: 5381 - protein, 13 aa, Homo sapiens
WFLQHRPQVGYIR

SEQ ID NO: 5382 - protein, 9 aa, Homo sapiens
WFYIASAFR

SEQ ID NO: 5383 - protein, 7 aa, Homo sapiens
WGAAPYR

SEQ ID NO: 5384 - protein, 13 aa, Homo sapiens
WGIEGPIDAAFTR

SEQ ID NO: 5385 - protein, 11 aa, Homo sapiens
WGLNELKPISK

SEQ ID NO: 5386 - protein, 9 aa, Homo sapiens
WGVASFLQK

SEQ ID NO: 5387 - protein, 7 aa, Homo sapiens
WHQVEVK

SEQ ID NO: 5388 - protein, 21 aa, Homo sapiens
WIYHLTEGSTDLRTEGRPDMK

SEQ ID NO: 5389 - protein, 8 aa, Homo sapiens
WKDNLQHK

SEQ ID NO: 5390 - protein, 9 aa, Homo sapiens
WKTTFDPKK

SEQ ID NO: 5391 - protein, 16 aa, Homo sapiens
WKYEKPDGSPVFIAFR

SEQ ID NO: 5392 - protein, 8 aa, Homo sapiens
WLDLSHNR

SEQ ID NO: 5393 - protein, 12 aa, Homo sapiens
WLPSSSPVTGYR

SEQ ID NO: 5394 - protein, 8 aa, Homo sapiens
WLQAQKDK

SEQ ID NO: 5395 - protein, 10 aa, Homo sapiens
WLQGSQELPR

SEQ ID NO: 5396 - protein, 7 aa, Homo sapiens
WLSEEQR

SEQ ID NO: 5397 - protein, 8 aa, Homo sapiens
WLTFSLGK

SEQ ID NO: 5398 - protein, 21 aa, Homo sapiens
WLTPFDPVFTEVDTFHLDKYK

SEQ ID NO: 5399 - protein, 17 aa, Homo sapiens
WNFEKFLVGPDGIPIMR

SEQ ID NO: 5400 - protein, 13 aa, Homo sapiens
WNFYYSPQSSPDK

SEQ ID NO: 5401 - protein, 6 aa, Homo sapiens
WNNLLR

SEQ ID NO: 5402 - protein, 9 aa, Homo sapiens
WNNYMMDWK

SEQ ID NO: 5403 - protein, 11 aa, Homo sapiens
WNVASLIYETK

SEQ ID NO: 5404 - protein, 8 aa, Homo sapiens
WNYIEGTK

SEQ ID NO: 5405 - protein, 8 aa, Homo sapiens
WPEPVFGR

SEQ ID NO: 5406 - protein, 8 aa, Homo sapiens
WRDSLEFR

SEQ ID NO: 5407 - protein, 17 aa, Homo sapiens
WRDSLEFREIGELYLPK

SEQ ID NO: 5408 - protein, 10 aa, Homo sapiens
WRNDLISATK

SEQ ID NO: 5409 - protein, 16 aa, Homo sapiens
WSAGLTSSQVDLYIPK

SEQ ID NO: 5410 - protein, 9 aa, Homo sapiens
WSGAVLAGR

SEQ ID NO: 5411 - protein, 12 aa, Homo sapiens
WSRPQAPITGYR

SEQ ID NO: 5412 - protein, 10 aa, Homo sapiens
WTLTAPPGYR

SEQ ID NO: 5413 - protein, 14 aa, Homo sapiens
WTYHYSEKPMNWQR

SEQ ID NO: 5414 - protein, 12 aa, Homo sapiens
WVFKEEDPIHLR

SEQ ID NO: 5415 - protein, 18 aa, Homo sapiens
WVMVPMMSLHHLTIPYFR

SEQ ID NO: 5416 - protein, 13 aa, Homo sapiens
WWGGQPLWITATK

SEQ ID NO: 5417 - protein, 25 aa, Homo sapiens
WYLFGMGNEVDVHAAFFHGQALTNK

SEQ ID NO: 5418 - protein, 28 aa, Homo sapiens
WYLFGMGNEVDVHAAFFHGQALTNKNYR

SEQ ID NO: 5419 - protein, 11 aa, Homo sapiens
WYQQKPGQAPR

SEQ ID NO: 5420 - protein, 11 aa, Homo sapiens
WYQQLPGTAPK

SEQ ID NO: 5421 - protein, 14 aa, Homo sapiens
WYVPVKDLLGIYEK

SEQ ID NO: 5422 - protein, 14 aa, Homo sapiens
YAASSYLSLTPEQW

SEQ ID NO: 5423 - protein, 15 aa, Homo sapiens
YAASSYLSLTPEQWK

SEQ ID NO: 5424 - protein, 15 aa, Homo sapiens
YAASSYLSLTPEQWR

SEQ ID NO: 5425 - protein, 8 aa, Homo sapiens
YAFELKEK

SEQ ID NO: 5426 - protein, 14 aa, Homo sapiens
YAGSQVASTSEVLK

SEQ ID NO: 5427 - protein, 22 aa, Homo sapiens
YASDLDKVEGLTFQQNSLNWMK

SEQ ID NO: 5428 - protein, 7 aa, Homo sapiens
YASPTAK

SEQ ID NO: 5429 - protein, 8 aa, Homo sapiens
YASPTAKR

SEQ ID NO: 5430 - protein, 10 aa, Homo sapiens
YAVSEAAAHK

SEQ ID NO: 5431 - protein, 19 aa, Homo sapiens
YAVSEAAAHKYGIDWASGR

SEQ ID NO: 5432 - protein, 6 aa, Homo sapiens
YDDLVR

SEQ ID NO: 5433 - protein, 17 aa, Homo sapiens
YDSVSVFNGAVSDDSRR

SEQ ID NO: 5434 - protein, 8 aa, Homo sapiens
YEMHELLR

SEQ ID NO: 5435 - protein, 9 aa, Homo sapiens
YEVSVYALK

SEQ ID NO: 5436 - protein, 15 aa, Homo sapiens
YEVSVYALKDTLTSR

SEQ ID NO: 5437 - protein, 7 aa, Homo sapiens
YFAGFPR

SEQ ID NO: 5438 - protein, 12 aa, Homo sapiens
YFHHNSDFHIPK

SEQ ID NO: 5439 - protein, 12 aa, Homo sapiens
YFHHNSDFYIPK

SEQ ID NO: 5440 - protein, 8 aa, Homo sapiens
YFIDFVAR

SEQ ID NO: 5441 - protein, 8 aa, Homo sapiens
YFSIPGSR

SEQ ID NO: 5442 - protein, 8 aa, Homo sapiens
YGAATFTR

SEQ ID NO: 5443 - protein, 9 aa, Homo sapiens
YGAIETVNR

SEQ ID NO: 5444 - protein, 9 aa, Homo sapiens
YGDDEKYFR

SEQ ID NO: 5445 - protein, 13 aa, Homo sapiens
YGDSGEQIAGFVK

SEQ ID NO: 5446 - protein, 12 aa, Homo sapiens
YGFIEGHVVIPR

SEQ ID NO: 5447 - protein, 9 aa, Homo sapiens
YGFYTHVFR

SEQ ID NO: 5448 - protein, 26 aa, Homo sapiens
YGGGFYSTQDTINAIEGLTEYSLLVK

SEQ ID NO: 5449 - protein, 15 aa, Homo sapiens
YGGPNHHLPLPDNWK

SEQ ID NO: 5450 - protein, 9 aa, Homo sapiens
YGHSLALYK

SEQ ID NO: 5451 - protein, 9 aa, Homo sapiens
YGIDWASGR

SEQ ID NO: 5452 - protein, 6 aa, Homo sapiens
YGIYTK

SEQ ID NO: 5453 - protein, 12 aa, Homo sapiens
YGKPVQGVAYVR

SEQ ID NO: 5454 - protein, 11 aa, Homo sapiens
YGLVTYATYPK

SEQ ID NO: 5455 - protein, 7 aa, Homo sapiens
YGMWTIK

SEQ ID NO: 5456 - protein, 12 aa, Homo sapiens
YGNQDTSSQLKK

SEQ ID NO: 5457 - protein, 11 aa, Homo sapiens
YGQPLPGYTTK

SEQ ID NO: 5458 - protein, 8 aa, Homo sapiens
YGRAPQLR

SEQ ID NO: 5459 - protein, 16 aa, Homo sapiens
YGRNQGNTWLTAFVLK

SEQ ID NO: 5460 - protein, 16 aa, Homo sapiens
YGVYSYIHHNKDWIQR

SEQ ID NO: 5461 - protein, 25 aa, Homo sapiens
YHFEALADTGISSEFYDNANDLLSK

SEQ ID NO: 5462 - protein, 22 aa, Homo sapiens
YHFVTPLTSMVVTKPEDNEDER

SEQ ID NO: 5463 - protein, 27 aa, Homo sapiens
YHQDTQGWGDIGYSFVVGSDGYVYEGR

SEQ ID NO: 5464 - protein, 9 aa, Homo sapiens
YHSHIDAPK

SEQ ID NO: 5465 - protein, 6 aa, Homo sapiens
YHYLIR

SEQ ID NO: 5466 - protein, 19 aa, Homo sapiens
YIEKIQPSGGTNINEALLR

SEQ ID NO: 5467 - protein, 9 aa, Homo sapiens
YIETDPANR

SEQ ID NO: 5468 - protein, 11 aa, Homo sapiens
YIETDPANRDR

SEQ ID NO: 5469 - protein, 8 aa, Homo sapiens
YIFDNVAK

SEQ ID NO: 5470 - protein, 21 aa, Homo sapiens
YIPYTLYSVFNPSDHDLVLIR

SEQ ID NO: 5471 - protein, 13 aa, Homo sapiens
YISGMAPRPSLAK

SEQ ID NO: 5472 - protein, 9 aa, Homo sapiens
YIYGKPVQG

SEQ ID NO: 5473 - protein, 14 aa, Homo sapiens
YIYGKPVQGVAYVR

SEQ ID NO: 5474 - protein, 16 aa, Homo sapiens
YIYPLDSLTWIEYWPR

SEQ ID NO: 5475 - protein, 10 aa, Homo sapiens
YKATLLDIYK

SEQ ID NO: 5476 - protein, 27 aa, Homo sapiens
YKATLLDIYKTGEAVAEKDSEITFIKK

SEQ ID NO: 5477 - protein, 12 aa, Homo sapiens
YKEENDDFASFR

SEQ ID NO: 5478 - protein, 15 aa, Homo sapiens
YKEENDDFASFRVDR

SEQ ID NO: 5479 - protein, 18 aa, Homo sapiens
YKEENDDFASFRVDRIER

SEQ ID NO: 5480 - protein, 7 aa, Homo sapiens
YKHSVVK

SEQ ID NO: 5481 - protein, 11 aa, Homo sapiens
YKKGGVASGFK

SEQ ID NO: 5482 - protein, 12 aa, Homo sapiens
YLAEVAAGDDKK

SEQ ID NO: 5483 - protein, 25 aa, Homo sapiens
YLDKTEQWSTLPPETKDHAVDLIQK

SEQ ID NO: 5484 - protein, 8 aa, Homo sapiens
YLDSTFTK

SEQ ID NO: 5485 - protein, 10 aa, Homo sapiens
YLDWIHGHIR

SEQ ID NO: 5486 - protein, 8 aa, Homo sapiens
YLESAGAR

SEQ ID NO: 5487 - protein, 8 aa, Homo sapiens
YLFLNGNK

SEQ ID NO: 5488 - protein, 6 aa, Homo sapiens
YLKYSK

SEQ ID NO: 5489 - protein, 10 aa, Homo sapiens
YLLKGEYVGK

SEQ ID NO: 5490 - protein, 10 aa, Homo sapiens
YLQGSSVQLR

SEQ ID NO: 5491 - protein, 6 aa, Homo sapiens
YLSQMK

SEQ ID NO: 5492 - protein, 11 aa, Homo sapiens
YLSSHIANVER

SEQ ID NO: 5493 - protein, 15 aa, Homo sapiens
YLTSEMHGARPGASK

SEQ ID NO: 5494 - protein, 6 aa, Homo sapiens
YNELLK

SEQ ID NO: 5495 - protein, 6 aa, Homo sapiens
YNFSFR

SEQ ID NO: 5496 - protein, 18 aa, Homo sapiens
YNPVVIDFEMQPIHEVLR

SEQ ID NO: 5497 - protein, 13 aa, Homo sapiens
YNQQNHYDGSTGK

SEQ ID NO: 5498 - protein, 15 aa, Homo sapiens
YNSQNQSNNQFVLYR

SEQ ID NO: 5499 - protein, 9 aa, Homo sapiens
YNWRENLDR

SEQ ID NO: 5500 - protein, 15 aa, Homo sapiens
YNWRENLDRDIALMK

SEQ ID NO: 5501 - protein, 27 aa, Homo sapiens
YPIEHGIITNWDDMEKIWHHTFYNELR

SEQ ID NO: 5502 - protein, 11 aa, Homo sapiens
YPLSIEPIGVR

SEQ ID NO: 5503 - protein, 9 aa, Homo sapiens
YQDYKITQR

SEQ ID NO: 5504 - protein, 7 aa, Homo sapiens
YQGNPLR

SEQ ID NO: 5505 - protein, 16 aa, Homo sapiens
YQIWTTVVDWIHPDLK

SEQ ID NO: 5506 - protein, 17 aa, Homo sapiens
YQIWTTVVDWIHPDLKR

SEQ ID NO: 5507 - protein, 14 aa, Homo sapiens
YQYNTDVVFDSQGK

SEQ ID NO: 5508 - protein, 13 aa, Homo sapiens
YREYTDASFTNRK

SEQ ID NO: 5509 - protein, 39 aa, Homo sapiens
YRLHDNQNGWSGDSAPVELILSDETLPAPEFSPEPESGR

SEQ ID NO: 5510 - protein, 24 aa, Homo sapiens
YRSWVPHTFESELSDPVELLVAES

SEQ ID NO: 5511 - protein, 9 aa, Homo sapiens
YRVFALDQK

SEQ ID NO: 5512 - protein, 19 aa, Homo sapiens
YSAVDPTKDIFTGLIGPMK

SEQ ID NO: 5513 - protein, 16 aa, Homo sapiens
YSAWAESVTNLPQVIK

SEQ ID NO: 5514 - protein, 9 aa, Homo sapiens
YSGVTLDPR

SEQ ID NO: 5515 - protein, 19 aa, Homo sapiens
YSHYNERDEIPHNDIALLK

SEQ ID NO: 5516 - protein, 12 aa, Homo sapiens
YSLNDDLKPAKR

SEQ ID NO: 5517 - protein, 12 aa, Homo sapiens
YSLTYIYTGLSK

SEQ ID NO: 5518 - protein, 11 aa, Homo sapiens
YSPGGTPTAIK

SEQ ID NO: 5519 - protein, 10 aa, Homo sapiens
YSPNYNPQSR

SEQ ID NO: 5520 - protein, 13 aa, Homo sapiens
YSSDYFQAPSDYR

SEQ ID NO: 5521 - protein, 10 aa, Homo sapiens
YSSLAEAASK

SEQ ID NO: 5522 - protein, 12 aa, Homo sapiens
YTDSTFRVPVER

SEQ ID NO: 5523 - protein, 13 aa, Homo sapiens
YTELPYGREDVLK

SEQ ID NO: 5524 - protein, 10 aa, Homo sapiens
YTFVVPEDTR

SEQ ID NO: 5525 - protein, 6 aa, Homo sapiens
YTIQTK

SEQ ID NO: 5526 - protein, 7 aa, Homo sapiens
YTTEIIK

SEQ ID NO: 5527 - protein, 11 aa, Homo sapiens
YTTTMGVNTYK

SEQ ID NO: 5528 - protein, 20 aa, Homo sapiens
YTYNYEAESSSGVPGTADSR

SEQ ID NO: 5529 - protein, 6 aa, Homo sapiens
YVALLK

SEQ ID NO: 5530 - protein, 15 aa, Homo sapiens
YVGGQEHFAHLLILR

SEQ ID NO: 5531 - protein, 13 aa, Homo sapiens
YVGNMHGNEALGR

SEQ ID NO: 5532 - protein, 9 aa, Homo sapiens
YVLPNFEVK

SEQ ID NO: 5533 - protein, 7 aa, Homo sapiens
YVLSPYK

SEQ ID NO: 5534 - protein, 14 aa, Homo sapiens
YVNKEIQNAVNGVK

SEQ ID NO: 5535 - protein, 8 aa, Homo sapiens
YVNWIKEK

SEQ ID NO: 5536 - protein, 8 aa, Homo sapiens
YVQKGEYR

SEQ ID NO: 5537 - protein, 17 aa, Homo sapiens
YVRPGGGFVPNFQLFEK

SEQ ID NO: 5538 - protein, 27 aa, Homo sapiens
YVRPGGGFVPNFQLFEKGDVNGEKEQK

SEQ ID NO: 5539 - protein, 23 aa, Homo sapiens
YVSHFETEGPHVLLYFDSVPTSR

SEQ ID NO: 5540 - protein, 15 aa, Homo sapiens
YVTSAPMPEPQAPGR

SEQ ID NO: 5541 - protein, 10 aa, Homo sapiens
YWGVASFLQK

SEQ ID NO: 5542 - protein, 7 aa, Homo sapiens
YYADSVK

SEQ ID NO: 5543 - protein, 10 aa, Homo sapiens
YYGDDEKYFR

SEQ ID NO: 5544 - protein, 21 aa, Homo sapiens
YYPYQSFQTPQHPSFLFQDKR

We claim:

1. A method of diagnosing or prognosing liver fibrosis in a subject comprising:
   detecting at least two, at least 3, at least 4, or at least 10 liver fibrosis-related molecules listed in any of Tables 1, 2, 3, 5, 6 and 12 and any of SEQ ID NOS: 1-5544 in a sample obtained from the subject;
   comparing expression of the at least two liver fibrosis-related molecules to controls representing expression of the at least two liver fibrosis-related molecules expected in a subject who does not have liver fibrosis; and
   diagnosing or prognosing liver fibrosis in the subject when differential expression of the at least two liver fibrosis-related molecules between the sample and the control is detected, wherein differential expression comprises an increase or decrease of at least 10% relative to the controls.

2. The method of claim 1, wherein diagnosing or prognosing liver fibrosis comprises diagnosing or prognosing fast-progressing liver fibrosis or slow-progressing liver fibrosis.

3. The method of claim 1, wherein the at least two liver fibrosis-related molecules are listed in: Table 2; Table 3 or Table 5.

4. The method of claim 1, wherein expression of at least five, six, seven, eight, nine, ten, eleven, twelve, thirteen, fourteen, fifteen, sixteen, seventeen, eighteen or nineteen liver fibrosis-related molecules are detected.

5. The method of claim 1, wherein the subject is diagnosed or prognosed with liver fibrosis when differential expression of the at least two liver fibrosis-related molecules between the sample and the control is detected, wherein differential expression is detected for at least 80% of the at least two liver fibrosis-related molecules.

6. The method of claim 1, wherein the method is a method of diagnosing or prognosing fast-progressing liver fibrosis, and wherein the method comprises:
   diagnosing or prognosing fast-progressing liver fibrosis when differential expression of the at least two liver fibrosis-related molecules between the sample and the control is detected, wherein the at least two liver fibrosis-related molecules are selected from those listed in Section B of Table 6; or
   diagnosing or prognosing fast-progressing liver fibrosis when increased expression of the at least two liver fibrosis-related molecules in the sample is detected, wherein the at least two liver fibrosis-related molecules are selected from the group consisting of F10, FN1, C5, SERPINA4, VTM and LUM.

7. The method of claim 1, wherein the method is a method of diagnosing or prognosing slow-progressing liver fibrosis, and wherein the method comprises:
   diagnosing or prognosing slow-progressing liver fibrosis when differential expression of the at least two liver fibrosis-related molecules between the sample and the control is detected, wherein the at least two liver fibrosis-related molecules are selected from those listed in Section A of Table 6, or
   diagnosing or prognosing slow-progressing liver fibrosis when decreased expression of the at least two liver fibrosis-related molecules between in the blood sample is detected, wherein the at least two protein liver fibrosis-related molecules are selected from the group consisting of F10, FN1, C5, SERPINA4, VTM and LUM.

8. The method of claim 1, wherein the controls are reference values for a population of subjects who do not have liver fibrosis or who has non-progressing liver fibrosis.

9. The method of claim 1, wherein the subject has or is suspected of having post-transplant liver fibrosis and method is performed at least 30 days after liver transplant.

10. The method of claim 1, wherein the method:
    has a sensitivity of at least 95% and a specificity of at least 95% for the detection of liver fibrosis;
    has a sensitivity of at least 95% and a specificity of at least 95% for identifying fast-progressing liver fibrosis; or
    combinations thereof.

11. The method of claim 1, wherein differential expression of the at least two liver fibrosis-related molecules is detected within 30 days after the onset of pathological fibrotic change in the liver.

12. The method of claim 1, wherein differential expression of the at least two liver fibrosis-related molecules is detected at least 180 days before onset of clinical signs or symptoms that indicate liver fibrosis or at least 90 days before elevation in aspartate aminotransferase (AST), alanine aminotransferase (ALT) or alkaline phosphatase (AP).

13. The method of claim 1, wherein:
    differential expression of the at least two liver fibrosis-related molecules is detected at least 100 days before onset of clinical signs or symptoms that indicate fast-progressing liver fibrosis; or
    differential expression of the at least two liver fibrosis-related molecules is detected at least 100 days before onset of clinical signs or symptoms that indicate slow-progressing liver fibrosis.

14. The method of claim 1, wherein the method further comprises detecting expression of one or more control proteins or nucleic acid molecules.

15. The method of claim 1, further comprising treating the fibrosis when the subject is diagnosed or prognosed with liver fibrosis.

16. The method of claim 1, wherein detecting the at least two liver fibrosis-related molecules comprises analyzing the sample using ion mobility spectrometry and mass spectrometry.

17. The method of claim 1, wherein detecting at least two liver fibrosis-related molecules comprises quantification of the at least two liver fibrosis-related molecules.

18. The method of claim 15, wherein treating the fibrosis comprises administering an anti-fibrotic therapy shown in Table 8 to the subject diagnosed or prognosed with liver fibrosis.

19. The method of claim 1, wherein the method is a method of diagnosing liver fibrosis, and wherein the method comprises:
    detecting at least 10 liver fibrosis-related molecules listed in Table 12 in a sample obtained from the subject;
    comparing expression of the at least 10 liver fibrosis-related molecules to controls representing expression of the at least 10 liver fibrosis-related molecules expected in a subject who does not have liver fibrosis; and
    diagnosing or prognosing liver fibrosis in the subject when differential expression of the at least 10 liver fibrosis-related molecules between the sample and the control is detected, wherein differential expression comprises an increase or decrease of at least 10% relative to the controls.

20. The method of claim 19, wherein the at least 10 liver fibrosis-related molecules comprise: sulfhydryl oxidase 1 (QSOX1), extracellular matrix protein 1 (ECM1), galectin-3-binding protein (LGALS3BP), lumican (LUM), vitronectin (VTN), dopamine beta-hydroxylase (DBH), transthyretin (TTR), cholinesterase (BCHE), retinol-binding protein (RBP4), and insulin-like growth factor binding protein, acid labile subunit (IGFALS).

* * * * *